United States Patent 11,549,145 (METHODS AND COMPOSITIONS FOR INHIBITING AND TREATING NEUROLOGICAL CONDITIONS) - sequence listing, part 119

SEQ ID NO: 2182 - DNA, 170456 bp, Homo sapiens
tacccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggtaagagttgggcaaactcaactccggcggctcctggaccttggccggacgccggaaggcttctcatgggcgggggtcacattttccttagccagggtaccggggtgcggcgtgaggtggggcgagatgggctcagtctgcgttgttcatgcgcttcttaagggtttattgttgtttgcatttggttttgttacatgggattgtgtaggaaaatcctggagtatttttgatggagagacatcctcattacgcattttattttgcataattcctgcccttgtattgccttaccttgtgtttgtttcattttgccgggcgatatagctggatgtagggagatttgtggggaatcggactgagcttgaaaggcagtttcagctgggccctttcttctaggtcagttgaacttcctttctgggatcttcactgttttctaaacttctctttctcccgtccttggtattcagattgtgcagataacgctctaggctggcgggatgctcccctttcctgagttctcagcgatcagtaggggtgtgaggtcgcagtcttagaccaaaggggccttgtcagtatgcttggctccttaaggagtgctgggagggacggtttttcaagtgatagttacttaagaaagataaatccggtgttgatctttttcttttaaattccttgttagaggacttttacgcctggtttaaggaagtgttttggccttaattttctttctggaagtatttttcttagtgacaccactgagcaaatgaatgatggcaatatctttgctgcttctttagaaaatatcctcacgcaaggacccacattatttaggagaaagtcaaagttggagatcttattagccaaaattagccattattattgttcttaggctgtgataaccatgctgtgccaaggcagaagagaatgacatttcttcttgttcttcttgccttactcctttatatcctgggtctcactttgtgtatagggttcccaaataaaaatgcttcattccttatggacagaaatactggggccaatttatattatccagaaatgtcatcttcctgacacgagtgctccaagaggtcagcttgcagggaacttttaattttaccactgagagttcaaagagttcagttggtaaactctgggcacccgccagcctgggttcagctcacaactctgccacttttcagttctgtgattttggggtaagttacttaatctgtttatccacatatgtaaaatcaaaatgataataatagcacttacatcagacaattgttaaagggattaagtaagttaatgcatgtgaaggactaacaagcctgacacatagtaggcacaaattagctttattattattgtatagctagcattaactattgttgtatccctctagtatagcttctattagctgtcagtaagtgttagctattattcctatttggatggactttgaagactgtgctcatctgtaagcttcactaccacctattgtcaaacttagctcagacatgatctttgtattgcttttttgttgtggcactttcagttggaaaaataaaggtgtatatggcagagctggaatttatagggtggtgggtcatggatgggcaccaaagactacttggaacaggtgaggaggtgggaaatctacactcagttcacagcctgtatacctccttggaaatcctttacattaatatactttctttaacctattttttagaggtcactcatttgttcagtaagtatttattaaccatctattacatgtcaagcactgttttaggttttatattttaaaaatggctatgcatgagtattggctttatgtgcctcctcccatttcaagtgtgtgacctagcactctataaattaaatcccaagtatttttagctacacaatttccatacctgttaaaatgctcataagagcacataaaaagcacgtatcattgagaaattgaacaaaatattccctatgacctcaagcagattgcttttctccatttaggcatcagttttattatgtataaacttgtgttgagaggtggggaaagagtagaataacctccagtgttccttctggctccaaaatccttaaattagctgccttacttcattggtggctgtttttgaacccccacttttctcttttaacatttgttttaggtacataaattacgttacttccatctttgcatattcatcaaagtgagtaacaacatcgataattaatgaaaagggaaaagcgtttatctctgtctgtctttcactattctcagactttggtttataccagaagcatgaagtggggagatttgttaaaatattagagtgaactatgagaaattgctgatatttgaccatttttgacctaaataaatggcaattttgtatggttcaaactatacaaaccctaatcccttctgccttgatttagaagtagtaagtcttctgtgagttgtgagaagtctgcatttttacaagttccccaggtgattctaatgcaaaactcaagtcacatgctcatttagcagcagtgaatttaccttctttgtgattgtctgcttggtttaatagtgtatttctaaaatgcaaatctgatcatgttattcccttgtttaaaaatctttggcagctctctggatggtgaatgtcagtgttacctgggtgcatgttgaaaatatagattccagggcttcaccccagaagtaagggccagtaatctgcattttgagatctccaggtgaacctggtaaagctgacgtcagatcacatttggagaaacactggcttacagcataaagtctcacctccttaccgctatacacaagaccacctttgcagcacttctcagggttattttctgcttctctggtccccagctctccagctcccactgatcttgatcttgttactatctcaagaatacgctgtgcactttcactcttccatgacccagctgtatatgctgttccttcctctgaaaatgtctttgaccctctttcctgtctaaccaaccacttaccacccattcatcttttaagacactattcaaatccctttgaagactttccctctgaagtttttcccaattatctcataaacttagcgatatctcatgcgagttcccattcttgtggatagatttaatatagcataatcacattgtatcagccatatttattatctgaatgtttatccctaacagattggtgagttcatcattccttattgtaagctcttatacaagtggctggcccatagtagttatggaataaatgcctagagaatgttggagaaaagtaaatggatgaatgatagtcaacattttcttagcagacaaagtggttgggacagtattgtatacatatggagggtgtggaaaagccagttgggaatttccagtttggctagacatagcctaggaagttaataacttcaagtggggctgggcatggtgcctcacgcctgtaatcccagcactttgtgaggctgaggtgggaagatcacttgaggccagggatcctagaccagcctggccaaaatggcgaaatcctgtctctactaaaaataccagaattagccgtgagtggtagcacacacctgtaatcccaactacttgggaggctgaggcacaagaatcacttgaacttgggaggcagaggttgcagtgagctgagatcgcgacactgcactccagcctgggtgacagagtgagactctgtctcaaataataataataataataataataataataataataaataacttggagtagaaaaaggacaagacagaatatcctaagaggacttatgaaacaccaaatgccactgaattaatgttacatgttgaacattattgcaggcagtataatgaagagctgagcttatcctttaggatggttttggtttggtttttggaatgacgtgtcagagcactggaaaggaagtgccaatgccaataaaaaccaactttgctctgtgcttttccatttataaaacacttctgcttctgtttttgtatttgatcagaaacatggtgactggttcaatactgtctttccttctttcctgaaaggacacattcctgaaaataggtctgaagattgtataaaagcctacatattataggggattctggccatagaaagccaaatatattatgaaatctctaattatatcttgctatttagacacagcattcagtgtatactccattttctaatttttctttctttaaactttacacaattttggttattttctcctcatttcaataacagttgaccagctcaagttcaataaatgtctgattcagatgaaaagatttgccatttttggcatgtctaataacttctacctttgtcttacttagtttatgagacaaacacttctcataattactattaggcttttaattttcccatttcccattcacttttttgtaataatgaaaatatgcagtaacatttgaataagtgaatgaataattctctgggtaatgacaaggatggtgattctgcaaaaattgaactattggcttagggcagctgcaccataaaataaacaacataaaaagttcattcattagctggcatctgagtgtcatcatgacacagggcagggaggtagtagcatcaatagatgtagtacaaatatccacattgatggacttcaaacgaagcaatattgaggactgcctttactctcagtttctcaagggtgtgtacccagtatctggttttaataattagtttagttttaagaattaatacaagattcactgggttctgttgatttgtcttcttttaaaattatgtttctgaaatgaactttttctagcttagcataagcctgtatcattttctgccaacctttggaagtcttttaactgctctcctaatctctttattcagtcattcattcattcttcatatctgaatgtcctgaaatttttaatttaccttttgtctctctttaccattttgcattattgttcaccatgatcattctaactctttttaaatatagttattgcagaggactaatttagagcatttagtaaaaggatttctcatactatgagggaaaaagaaggtacaaaccaatgttattttactttatagaactttatttgtggaatggcaagtcactgtgtggatgttatttgataatgcaaactctgtggcattagccaatctggaaagtgtgaatgtgataatacatcctgttattatggttgttcatttctagtgatttcctctcttatttcatttctagtgatttatactcctagataaagaaactatgtaaagcatttaagcacctcaatttcctacttagagggcaataaattgtaccccttcccacttctaagacaaagaaaacagtatttcagtatggaaaacctcatcttgataggtacatgtgcaggatattagcatctgttaaaaacatcttatctttgggaacatcctagaggatgactaagtgccttgtcattaatgtctcatctgacccagatgagctgtacagatttggctgtttctcaacatagccacaggtggtggttcccaagatggatcttttgaataccttctgctgaagaattttggctttcttaaaaaataatttttgatggcaaattgaaaactaaaacacacaaatttaacttgttcctcacagagtgaaatagaactatgaaatttttgcttggtggcacagaagactaatcctacaatcaaaacaaaaaaatttaaatatccacccctattgacatcttgagaaaagtacttgagtttggatgaagaattgataaaaaatatgtgacttggttctttaaaaaagtaataggttggagagttactttttgttccaccagttttttttgttttgttttgttttgttttttgaagtggagtttcattcttgttgcccaggctggagtgcaatggcgcaatctcaactcactgcaacctccgcctctggggttcaagtgatcctcctgcctcagcatcccgagtagctgggattacaggcatgtgtcaacatatctgactaatttttgtatttttagtagagacgaggttttgccatattggccaggctggtctcgaactcctgacctcaagtgatctgcctgcctcagcctctcaaagtactggaattacaggcatgagccactgcacctggctgtttatcagatatttattagctgtgtagggcataggggaaaataccatgtgtaattaccaagaagctcttgccttcgaggaaaaaacagactaaaaaagtacacattgcatgcccatataaaatatctcatgtaacccataaatatatacatctactatgtaccctcaacaattaaaaaaaaaacaacaactgagcaggtaagcctgggtatagtaagagccaagtggcagttttgagagctgccacaagagctcactggaggcttcctggcagtgtgggaccttgaaggagagatttgaatggatggggcatcttaggtgggggaatgggctcagcaaacatgtggtggcaggaatttacaaagcatcttcaagcaatagtgattaaaccattccatagtagtggtgagtttacatttgagaataattttataataggcacttacaggacctgcccatccccatagtactatctgcgttaaaggaacccttcacattacactgcagttattttatagaaactagatgggattagggggacctattgagattcaagtaaaaattggctagaaatcttcctccctattccatgagaaggtgtaaaatgagaaaactgttcttcctttcaaccactatgggattcttggggctagagacggagacagggctcatgtttcttctagtgtcacctggatctgaattcatattttcccttaagaagtttaaaatgatccgaagccactcacccagccacgaataaccttcacttcataaaatgccaccaaatgtgtggcttgagtgtttagaattttaaggtttgggactatggaaagagttcatatcttaacacttagaactaaatgttaaacatccttgctttctaacagttcatcctaccattgccactttctcaccgcccatctttttctgaaggctaccacctccaccaggtggcttcagcgctgtcctgctgtccctgcactcctcctctcttgctcactgatgacccacacccacattcctattatcatctgaagccctcatcgttctcacctgtcttcgtctcaggtgtttttcccccaacactaagatttgataaccacagtataaagtatttgtccttccagtatcctccctgctttcagctggttccttaaacagatgtgcaaaatcagaccatgagtgaggttagaaatgcttgaggcatgtttaccctgtgctctgacttcagaggcacgagaatcacctgcagatactggctcctccctagattttgattcggtaggtgcgtagtggggtcccaggatgtgtatttttaacaaggtgtgctgatgcaggtggcccatatatgcatgataatccttgttggacttatagtgccccattcaaaaggcatgccttttttgtgtgtttttaaattttagtgacttggccagagggggtcacagagaatagctggtctgtgagaacccatgcctctcctctctacttgaagggacaatggctgtaacacaacgctgttcatgtgacagccggagtaaaggacccattgttcaggggttggctgatgtgccattctgctgcggccagccgtccaactgagcttggtagccccaaggaaacagacacacttaaatcagagagacaaagaaaggaggtcaaggccttccacagttaaactacttgcagcaatgtgtcagaggtaggatctgggaaggaaaaaagtaattccaaggaagcatcattaatcctctggttttggagctgcagacatggcgttgggggaacacaagtctgtcaaaaagccagtggatctttggccaaggaagaattattttctactgcgtcacactgattgcaggacttatctgattgcaggattttattactgatttaaaaaataaaaaagcctccctgtgtccccaggctcatcaaaggtacctgatctgaaagcctgcctaaatcaaggtctatgacttcagagaacaattctgtgttcctgggaatggtcactgtgtatatattaataattcccttccagatctagatagctgttttgaagctaagaattttttgagtctgaaatacaatgagtgccattagaaagttattgataagtttggacagttatgaggctgggggactctccagatgccatctagataccctccctcacccctaactttcaaactggattctagccctggagggaaagggttgcaaacttcctgtaaaaatctaatcctgagcccaacaattgcttacattctttgtgtcagaagaagattcaaattcaaggtcacagcctttgcaaaggtcacagactttttccacaggattgttcttttagcctgattactccctttatgaaaaagtatgtcattcattcagcctttgcctctgggtttctttcaaagggagacttagttcctagttcctgtggatacttgtaggtggcttttcttttctttcctttttgtttttttttttttaagttaggcacagaatacagacttgaatgaggcagaacagggaaagccttttctggacgtgatgggttctggagagcccatttacaccaagtgttaggcagctggtgttccctggccagtaggaatccttttgtctctgagataagaggtttgtgtccaggagagggcaatatgtgatttgcttgaggtcacttagagctcctagtaattatgtctgtcattgtaccttgattatagattatcattgcaaatccattaaagaaggagaagcaagcggatttcagagaggcaagtagctttattttcttcattatgttttcattccccccctctgttacagtttgtttcttctttactaaatggttttgccaatgatatagatgactttgaagtggagaatgggaagaggagacttcgtgggtggcgaaaggactgtgctaaacactctcctgattagttcattaattttcaatttgttgccattaggcctgttcatttggctccccatttgtgtgatatagagaggcttgccctcaatgcttccaggcccgaatactgtgctatccttgaagttctgtgtaggtacagcactttttttaaaaataggaaagttaaatggtcccttttactgttgttgtttgtgtcccaagtagtatatataatactaaatgcttttgtaggcataggatgcttaatgggacttagttttgtgtcagaataagggtcctgcccaacaagggcttctgggatgctgacattacatttaatctaagcactggttgttatgggtatgttcagtttgtgaaaacttattgacctgttcagttttgatttatggctttttttctgtctgcattttacacttcaataaaaaattcaaaaattaaagccccatgtttaatgtagaattaaggatctatcatgatgggaaactggaaactctcacataatttgaatcctggtgcagctgggagggcctagagctttaaatacccatcaattcacccttacttctacagtcagagagctgtgtgtcagaatgcaatgcattagcaccatcataggtgattgctttacttctctaggcagcaactccaatgcctaagagatcaatagtgttagcagagccccactctttagaatctaaaacaaatgcacctctctaagttggccaagcagcaaatcttttcattcccactttccaccctcctttcactcattttagtctgtcaggagaaatcagaagaagactctatggattatggatgttttcctgaatctttggatgacatctctcttatggtctaatagtggaatgctttgtttccctccgatttctctaactgggatgagttgatatgaggggtgaagtctttggcttatctccgtcactcatttccactgacacttcctgagctcctcagtgagccacaggagcaatacctgcaaacccatgcttccagtcccagaacaacctgtcgtcctttttctcttgagaagacccttgtcctccatcagtgtggcgctgcatatattatactaaagtgagccatgagtcattgtactgatagaacattccagcttgcttttataatatggagttggtagactgaaatggagaaaataggagcattttttttttctccaaaagagagtttggggcccttcgctttgaaatgggtgcagcacatctatgagaggtctgagtactaaatgtgtacccttcattttggccattggacttacaggttggatgttgatttacacaaacacatgtgattaaagttgtgggttaacagacaagattctgatgttctgggtctattgctgaccttgtcatttactgtatgaggtatgacaaactgggctggaatcccttctctaccactgacatcttggtgactttgggcaggctactcaagctctctaaagcctcttttcatcaaatgtgaaaagataatagcatatacttcaaagattgttgcatttagcatagtggtaggcacatagtaaatgctcaatatatattagttattattatttaacaccaagtaatgttaaaatagggaagaataattaacacatctaggaatcaggtctgcttctcatgaaagaatcgttcaaatgcttaaataagattctattaattaaatgcagacgttagaaaatgtagtctctgatagaaggcataaactataaggaatttacaatattttggaatacaaaacagttaaatttacttataagcataaatgtcttttaagatagtatgttactaaacaaaaaattatttatcttaactatagaattaggatgaggctgctagtgaatgaatttgtttttccttagtaagatgtcaacagaattgaaaacaggtgttcaaacaatgtcttgtgtacaaatgctcctagcagcattatttacaacagccaaaactattatttttggtggaaacaacccaaatgtctatcaactgataaagggataaacaaaatgtgatatatttacagaatggaatattatttagtcatggaaagaaatgaagtatgtatgatacatgctacaacatggatgaaccttagcaatattatgctaagtgaaaaaagctagacacaaaagaccacatattgtgtggtttcacttatataaaatatctagaagaggcaactcaacagagacagaaagtagattagtgatttccagggtctgggggaagggaaaaattaggagtgactgtttgatgggcatggctttttcttttaggacaatggaaatattccagaactagatagtgatgatggttgcacaacagggttaaaatgatgaatgtttggttatgcaaattttttaaaggttaaaaaagttatctcaaaaaaatcagcagatgtttgcatttaggtgagatgtgtctgcatagatcagttgacccctggtcacgtgtgtgctatgaggcaagcctttgttgcatactgaggagaatgccaaaaatggcaagatgcagccttcagcgccttgccagtctgtttatgaggaaaggaaaggaggaggaagcaggtaatctgttccaagtgaatccgtctcagaaggagagatcatcggatttggtgaccagagaaggcttcttggaagagatgggacattgaaagatttgtgagctttgtgtaatcacagaagaggagagagtaccccaatggcagaaatgtacagccctggggagggagaggagtatgggcaaggacaagcagggatggccagactaaaggatttgtataatggaatatcaagagataaggttggggtcagtgcagtggctcatgcctataagcctagcactttgggaggccaaggtgggcggatcacttgaggtcaagagtttgagaccagcctggccaacatggcaaaacccagtctctactaaaattcaaaaattagctgggcatggtgatgtgcgcctataatcccagctactcgggaggctgaggcaggagaatcgcttgaactcaggaggcagaggttgcagtgagccgagattgcactactgcactccagtctggacaacagatcgagactccatgtcaaaaaaaaaaaaaaaaaaaagcaataaggttggaagtgtaggttggagccaagtagggaagtcctggaaacccggctgccagtgcttaagttaaattcaccaggcagtagatagcaaaggcttatcattgataataaaaacagaaaatgaaataaaaatggggaagacaataaggagactattgcagtaatttcactaattgcaacacaacccatcattatttattcagtaaatattgattgagccctcatactccatgcaatcttctatgctagggacagggcaatatctaagattaaacacatttcctgccctcctggagttgcattctagtacacatttcaagcattgacttctatgtccagtggacaaatgtagttgaaaagttaaggtgtggatgtattagaatgtagtggggtatgggtcctagaatcagatttcttggctttgaatcctggcttgccccattgttaactgaatgtatgtccatgaaacagttactctatgcttcagtttccttataatttaagaggggataattatgttagctctttaatagagctgttatgaagtttaattgagaaaataaatgaaaaggacttaggatagtacctggcatatagcaaatgctcagtagggctttcttgttttttgtatctgagattttaatttctactcaaggatttgtctaggtcacttctgtttttaactgagtgagtctatttcagaatcctggcatattgtatctcaggtctgagctctccttaatatgctgtatgattttggacattgaacttgttgaattaattagcatacaaactctgccttcctaattcaggcaagctgcaaaattcttctttccaacagaccacagttctggtcttgttttgggcagaagcttctagataatgctccttctagaccctgaatcaagaagtcttttgaagcatcctggcctgagagagcctgagaggtgacctgacctcaggacatctagtctccctctggagaagccatagtttgaatttaatttctttgtgttaccacatcataagggctatgggcctcctcagctctctgtgcctctgtgcccctttccatgagctgggatgaaatagccaactagaacaactatcaggacgtatgttctttttttgtttactattattattttttgggacaaagtctccctctgtcgctcaggctggagggcagtggcatcgtctcagctcactgtaacctctgcctcctgggttcaagtgattctcccacctcagcctcccaggtagctgggactacaggtgcctgccgccatgccctgctaatttttgtattttttggtagagacagggttttgccatgttggcctggctggtctcgaactcatgacctcaagtgatccacccgccttggcctcctaaagttctggagttacaggggtgatccactgcaactggcctggaggtgtgttcctatgagtgtattcagaaggatgcctcgaagcttgtggaaagagattgagaaagagagcccttaccagaaaccaaattggctaggaccttgatcttggacttcctgcctccagaaccataagaaataaatttctactggctaagccaccctgtctatggtattttgttaacagcctgagcagacgaaaacattaaaagagtatttgtggacctaatttcaagattattcagaattgtggtgacataagaaaaacatgaaaaactgaacctaacccacagtcctaatactcatttaaatggataatgttgactttatttcctatcatacattagtgaggccaaaaggttacagaatttgttggttaaaattcccccaagactcatttttcctctagaggaggtgctaatgagcagtgaaatagatcaaaactagtgagaaccatcgtcggagaatatgaggtaaggaaagagtctggacagtttgtatttcagacttttagttattgaacaattggcctcatagctgtgtgttcataggatgcacccagatttgagggggtgaaagtgtgaggggaggctgagtagcagaggcctgccagtgaggaaacacttcacctagcctaggagacatgtgaggtggttccttgcacccaagagatcctgcttccagaagagtgatgactgtgcctgaacccagccaaggattcaggtgtggagagttcctcactatagctaagccagatggtccacttttattttggtgaaggccaacctgaagcaaaggcacttttcttccgccattaaaaaaaacaacaaagcaaaaacagagacaaaaaagcttgtgatgtggagctctgccaagctagggctggaaaaaaaagtcccttgctttccttccaaggcagtatgtaaatgctgttttgtttgtgcagccaccggggatggtttagagtgcctcactaaagtccatggctgctatagaatctgatttttatgattatgaatatcctataagctaaccatctaggtctagttgtcacctccctgcacaatcatctttggttgaagatattgaattatactgcattgctatgaaagccaaatatcttcagaaagtgatcaccttaatctgtttatagaagctcgagcatgtgcttatgtgtagctctttccctaaaggacaggactctgatctttctgactttttctagagttcaggtgtggcaggcattaactgagacattaactcttcacccaaggaaggtttcttgtagcttaacctaaggagttttctgcttagctagagaatttggaagaccatttttcatttcttggccaggttgtgctatttacaaaaatgaggccatgtaattagggccccggtgccgtgtggatccattcactggtacataagagagactacagtgttttcatgggttagtggctgactgtgccctctctgtttcctttaatggtgaatatgtcactgctgagaaggatggcaaccaagtcctgacaggcagattttcagaacaaagtgttagtgagtgaagaaaggtctgtgcaagccaggcgaggtttgtcactgagttctaaggaacagttctttaaaaaaaacaagcaacttcccaatctgtgtctaggatttggatccagcataagtaaaactccaggtagagcaaaacccatttagcatatgctgggaactaccatgcccgtcttccatggtgcacttacagaaatgaggaggggactgggcctcacagcttggctccagctgctgtgccccagaagaaagagccatgtgcagtggccatcccatccattcactgtggcccatcattgttggcagctaagcgaagatgctcgcgggtggttagcgctgggcctcagattccttgttgaaggcccaatggggaacccatggttagaggaaagaagtccaggcgaagcggagctacctaaggagagacatgcttttaggaggtttcgcttcattgactcagttcaagttttatcttaaaggtactttatgctgggttgtggggggtggtggaatcagccgagtttgagattccagcattactcatgagccaagcttagctgcctgcttttagaattgcattaacttgaggtaatttttttaatgttttctaatcctggagcaaatgaaaatcattgacagtgatgcagatttcaaggccaatgtcactaatccatgaaaatgtttgttttattttgctttggcatggccttgaatgaaacaacaacaaagaaatccttccggagtgaaaggagcacgcttctcccctagagttctgttagataacccagaatactaaaaaaaatactggctctggagcctaaagaccttgccttgagttgtagctttgccacaccatatgatgttagacacctgaaaaaactcttctgtgcctcagtttctttcttcacaagacaaagagatcaaaaagtcccttcccaaccctgtgaacttgactagggagcctctggggccatgtctgggctgttggggtgcagctgagtggtgagaatggggtgggcagggttcatcactggcaaaagctatggcagagccccagcttcgcctgggctagatgttttgcctggccacggagctgcacaccgaatggaagttataagactgtgtgactgaaagtgtttattttgaggatgaatactaatatctaatatctgtggggcagctgtttccctgggtgctcttcctctatgttggctcatggtgagggcacagcctaaagagctctactgacatgtctcttcaaatacaactttagcatagtctcaaaatttcactaacttcagaccaaattcaaattttcttctatccatgatggagatattttcttccaacccaccatgatagatctttgggaacatgtataaaaattaatgttgctatcttcttttattttgaacttacaaatttaaaaaaaggaaattgttggctttaaaaattttgtaaagtctgttttctgtttgccaagagaccctgatggcacagagcttcggttcaggagtgtggtgtgtaaaccccggtcctcctccatggggtaatagagccctgggattctaatccatgccacatgcgatgacctgagcagaccctgtaggaaaacagaagtctcgctgtcccctcatggagcagttgctcacagtccgttgtacagctgtggcctgctttgttgggaagtgcagcgtgacttgatcttttaagctcttttctccctgtaggtattataaataacaactgctctgtgggagtacctgccaggagggcttgagatctgcattctgtactcaaaaagcattgttttttgtaatcttaacttcattagcaattacgagagaggagaaaaataaaacccaaaatcaaagtgactttgttatgatgcagaaaatccaaattagggaaataagaattgaaattgagaaagacaaactcctttaaaacctcaaattccttagaacttttctgagaacgtaaggaacacaaacaggtccagatccctaagatattccaagttcaacaaacaaatcagtttgaattcaggcaggctatcatcgagagctggaattctgacattgcacagtggctgcgaaatgcttgacgcccttttggtttccgtgtacttaaagttaagaaaatgtggcacatatacaccatggaatactatgcagccataaaaaatgatgagttcatgtcttttgtagggacatggatgaagctggaaaccatcattctcagcaaactatcgcaaggacgaaaaaccaaacactgcatgttctcactcataggtgggaattgaacaatgagaacacatggacacaggaaggggaacatcacacaccagagcctgttgtggggtggggggaagggggagggatagcattaggagatatacctaatgttaaatgacgagttaatgggtgcagcacaccaacatggcacatgtatacatatgtaactaaactgcatgttgtgcacacgtaccctaaaacttaaagtataattaaaaaaataataaaaataaataaaagtaaaaatacaaaaaaattaaaataaaaggttaagagaaagttaaattgctctattttggtttctgtgtatgggttctggagggattgccatctgtaacgagatgtaaaattctgggacactggcccaaggagaagggggtgaagagaccaggctgacacaggatcacactgttgttattatgttttgcctccttccactttcaagtcctagcaactgcattaccagtccatgtgcagtccttgtgatccatggaagaattcatgaatgtctgtcttaatcatgcagatgagtagtgaaaagaagtaaacaaggagttctcaccttttgggcagacatctgttacttacgctttaatactagcttgcttttagactttgtaaaatattgcggtaaaatgcacataacataccatacaattcagcatttttaatgtgtggttctgtggcattttaaatacattcacactgttgtgaaaccatcaccaccatccatctccagaactttttcatgatcccaaattgaaactctgtacccattaaatagcagctccccattttcctcttactccagcccttggcaaccaccattctactttctgtctttatgaatttgactactctatgtacttcatataaatggaatcagacagtatttattcttttgtaactggctgattttacttagaaataatgtcctcaaagtccagccaagttgtagcatgtgccagtttcattgctttttgaggctaaataatattcagttgtagtatataccacattgtgtttatccattcattcattaatggacatatgtgtcatttccaccttttgagtattgtgaatagtgctgctgtgaacattggtgtacaaatatctgttcaattccctgctttcaattcttttttgggtatatatacccagaaggggaattgctgcaacatatggtaattccatgttttttgaggaatcaccatactgtttttctacagtggctgctccattttacatttccgtcagcaatgcacaagagttccaatttttccacatccttgccaactctttctttctttctttctttctttctttctttctttctttctttctttccttccttccttcctttctttttttctttctttctttccttctttctttatttctttctttctttctttctctctttctttctttctttgtttcggagggggtgataatagcaatcctaatcagtgtgaagttatcgcattgtggtttgatttacatttccctaatgattagtgatacggccttttttaaatgtgcatattggccattggtatatcttcttttaaaaaatgtctatgcaagttatttgcccatattttaattaggttgtctgttttgttactgctatgttgtaggagttctttttatattgttgatattgatcctttatcatgtattacaaatattttctctcattctgtgggttgtgttttcactctgttgatagtgtcctttgttgcaaaaatttttaaattgtgatgaagttcagtttatctgttttctcttttattgcttgtgcttttagtatcatatccaagaatcattgccaattgcttttagattttttttaaggatagcccctttctctgtaataccacaaaaaccattacttgtagaaatttctctttgaagggattttgctctgagatgtctcttttttacttgtttggagagtggcctttttattacttgggaattggttgattccactttcaccatgctctatcattctcttctcttcttctcagggagatcacaaaggctcatttatggataaaaagaaaagagggagtgagggaaaggcttagtttgaaaatagcctcaatcatttgtagtataggggctaaggagagaaagggcaggtttcagaatgtctggggcatatgagtgggttctttagcaatcaagacttgcaaggagtctgtgacaccaaactggactgccatttgtctaagaaggctgagatctacttcctaaagcaccctccttttgtcctcaggctggaaagattgctgaaaagtgagcaggcccctagctgaacctctaaggaacctcagtccccctcccaaagacataatattccatgcctgaaacttctccaagtatatagacagtgactttttataaatgttcattcccttttagaaaacacaatatattcctcttatttctattaagtgttggtaaaatgcttctaattgaaaatccttttcctccctgccagtttctcatactttactcactattatttctggattatattctgtgtacaaaaatcaccatttaatagtgactacacatccaaacactacagatattgcttagtataaaaaagcaactggggagtacatcataaattcatacaatctcatcttgaagagcaaactaaatacagagacagcctgaaggacattcttctttacacttggcagttccagaagaatatatttaaatgttatgtaagttttagtcttttctcattacttatgtcacagctgtggacttctgagccatagggctgctgtttactttagacagacagttttgagttaggtgagtatttgagtattttcctacccagcatgtgttcagatgtgaggtgtttgcttttatgcttgtacgtctggtatgaaaaatggttttgtgtgccaataattgtccctgtgctgctgcctgcacagtaacttgactcaggaatacagagaactgtgtctggaatttgcagttttaagaagttgaatgatgacatacttcataaagagaactcttttcaaatgaactgtagtttaattagtagatccctcactcgcctatgtataggcttgaagaagtcggagaatagttttactgatgtcaaggaaggctggcagtaagtttctctaatatgcatgttacagaatgcaacgttaaattcctgaaatctcgtttggtgatggtcttcaaaaagaatcatttttattcacagggcctcaatcatctgagggactagatatccagagaagccagcttctcagtgttgcgtgcactttaaaaagtcataattaccgcaggagctaggaaatgctttaaatcagcagcatcccatcacaactcctaattttaatgtgtgcaagtaggcatcctaacaaaaccacagctcagcccccacctcgtctcgccttgctccttcctctctcactgtgcctccttttcatggtctccagggaagcatggtcagttttgaaggagggagagaaggcaaagagggatggaagtcagagcaagcagcccaggtcccacttctatcttaactggcaccaggaaaaagtgccttcggctggcacagtggcttgtgggcaccaggctttgcttgtttgccatataaatcctggtcataacagagaccaatgccattcaggcagtgagcaggaagctgcttttatggggagctttttggcaccgtgtccgacatacactccagtcaatcacagtaaagggcctaataacagatgtggtgattaagcctgaagaactgtctctattttttcatttttgtttcagagaataacaaagtgcttcattaaacccccaatcgcacagagttttgaattgggcatactgatgtggtaaaaacttacatctctgtaaggactttcttctgaagttcttatcagcaaggatgcctcagagggaaggttggatccttttagccaggacagttatgttctttctgggttgtgctttgcactccaataccaaaccatatgcagaatcctggggtacaaccagtttcctataagtaccttggatataaataaacagttttagcttttgtgtgcttttgtaaatgtaaaatgttctctgactctcttaggttcaattttactgcttatagcaagaaattaactatagctttcaatcttagaaaggtttcagataacctgaaaccatggtaaattaccatattttaataagataaattatcttgaaaaaaatttaattacatctgaaaaggtctgtctttgattgtggcagtttctaaggcaaatgtcttcattaaggttgtttttctttctttttaaatgatgaacatgaatctggctcatcattaaaggaaattaatctaagaatttaatgacttgggacaggtagaaaaagtatacgttctcaacagcaagaacacacagctgaaaactttctctttagctcttcctggattgtgaaggctggttctctgtgaccctggggctcttgggaaaggatggctgtctttctgacacggctctatgggatcgtgtagatttggaagccacatctatatcccagagataatttttttgtttgtttctaattccatgtagccatagatccactttgtaagattattgctttattatctttctccaaatgcatacttctgagttttcagggtacctccaagagaatttgtagttgactagattctcttaacctgacccataaagcatatgatttatggagaagaatcaagatttaattataatttcaattcttgtgttaataaagcataaacttaacctactcatccgattagcctaaaatgtaatttgtgtgtatttaacatttgtacacacttatatgcacggacacatataaaaacagtactaacctttatggcacttcatatttgttttctcgtctgaaacaatatttacaattcactttttactacctttatccatttagacaaccttttcctccattgatgttaaacatgtttcttgctaaatgtaaaatcagcaatgtacagactcagattttgccacattaaaatttgttttaagaaaccacccctatatacaccttgtatctaaaagtgagaactcccagatacattggggaagacttgtggtcaggcagacacctccctcaggattattcaattgctgaaaaagtaaagcttttctttaaataagattcagaataacttccttatagtttttcctaagaagggcaagactttctgggatgatacacctcatgttttactttcggttccattgctggtggggagatatttctgtaggttcggggagatgccttgaagatgaagtggaaagttggccaaccaagggcggccctgagctgaagcgccacctcctggcggaataggtcacttcagggattgtttctcagttacccaggctgcctgctgaggcatctgttctccccagttatggatcccactctgttatttctctcccacctcacccctctggatcggttgtctgggactcacaggatatgatctcttgactctcctcaagtgctcaatatactttaatgtttcatgactttatagatcctggtattgttcttacttagcaaccgtatattgatcatctatatattcttgcagatggggagagaagtagaagtcagggaggagtagaataggagacaagacaaaaccatgggctctgctttcaaggacccaacagtctagttgaagaggtgggattggttatgtcaaaagatgaccagcagcccaaggcaatggagaaatatcagatgaaggatgtggagagttggttccgttagagatttctatgcagtttctagtgaaaagactagagaatttttacttatgtcctgaacacactgttaagtagatcttggatgagaaaataaattattgcaaagagagaagtaagttgacagaaagcttatgtaatggtttgaatttcaaacaattagggaggcttacatgttggactaagggaattttaggaatgaatcataggctctttcaaattagcgggatatgaaaaatatattccaggcaggaactatttctacccttcatagattcttcaattgagatattcttcatgtatggtttacattcattagattttattttcctgtttaagttaaatgattaggaagtttaaaatcttgaacaaatgacagtaatatagtttatggaaactgtatttataagaaggaaatgaatgtattcattgtgatggggtgcacttaattttaagtgcttttggctgctgttgtttccaatatttgcagtaaaatgaagatactgctattaaagactttgaatcttaaaaaaaaggagctgagggagagaatttataataaaggcaacagggaaatgacatttgatgaggacaagaacagaagagattaaggaaaatgtcagagattgcaaagcttgtggccctgctgagttcagaactcagtgttagttcaaaaacctttagcttccttagttcaaattgcccttaaagagttatcagaacctgcttaaaattaaaggttttttccccataaaaactgtaattatcttgatattaatgttccagtttatttatgtatttatttttaacattatacttggtgtgcatttatgcccacctgtgcataaaggaaattcttgccttatttaggtaatatacaaacacttatgtacatttggggtccattaatatattttaaaatttataatcacaatgtgaccttcatcaaagaccatcacagatcttaattccttctcaaaattaaaacttaaaaatatatgaatcttgccgggcgtggtggcccatggctgtaatcccagaacttttggaggctgatagaggtgaattgcttgagcccaggagttcaagaccagcatgggcaatatgatgagacccgtctctacaaaaatacaaaaattagccaggtgtgttggaatgcatgtgtagtcccagctactcaggaggctgaggtgagaggatccattcagtttgggaggttgaggcagcagtgagctgtgattgtgtcactgcactccagcctgggtgacagagtgagaccctgtcttaaaaaaacaaaccaaaacaaaataaccctttttctttctgtctatatttcaagcatatattttgaatcactttgtaataaaaatctttttattttctaaagtgtgctaatctaacactctaagaacatgttgaagcagagcagtctttcagttgctgtagaccgtagcaatctgctaattactgaaggttcatcctagggtatattcccacacattgttctttctggtgaagtttgctgaaatgggtccctgtaccaggcccacaggcaggccccaggaattgtgctttttatcaatggagatgcaacacttcagaagacgctttagtgcaacaaaagtctgccatataagtttggtgccattgcacctttgctctgcctccttatcttgctttattacttcctgctggcttctgctgcttgactcccagcccctcctggatgctcccttgctgctgtcaaatgtttgctcatagtcacctcaccttgccctcagctgatatgaataccatgcctgcaagaatcatcaccaatgcagccatgtttgagcaggtccaattattgacaatacaggaaggctaatgagtagaaagccttaagctttaaatgaatttacagaatgattaactattaattaagccattgaaagtgcccatacgttcttttcagagactacatattttttatctctaattaaaacaaatatcccccaaacaaaactttcagtgttttttcatatttgtaatcactggtattgcaatcattttgtttcaactctaggattttccactgcagttgtatattagcaattaaatgataatcttgaccttccatttctgccttttaaatattaagaataatgatttcagggttccagaacaagtgatttgcatattctgagctttatttttcctgtgggccatacattcattcaagaataccaagaacatgtagagatgaacagtgtaccattctgacattaaggagtctggtagctagtggagagatgagcggtgtggtgtgtgttactactctgacgaagaacacatcagctactcttgggatgtttcagggtgttacaggagcaaagaagaagaatgacaaggttagccagggagctcttctaaaagaaagtgacagttgatccttaaagaatgagtgagaattaagttgagcagatagttaagggcattccaagaaggaacagcatgggcgaagacagaggagtgaaaacctctaatgtttggggaaaatcaagtacctgagaattgttcaagcgacatatacatgagtttgttgagtgatgaggctggactcagatatcttgagtcttaaatgccagtttgaattttacctaaaaggcaagctctcaaaagcttttaagaaggggagtgtggggttgtttgtttttttcttgtaaatttgttaaagttctttgtagattctggatattagccctttgtcagatgggtagattgcaaaaattttctcccattctgcgtgtccgctctgatggtagtttcttttgctgtgcagaagctctttagtttaattagatcccatttgtcaattttggcttttgttgccattgcttttggtgttttagtcatgaagtctgtgcccatgcctatgtcctgaatggcattgcctaggttttcttctagggtttttatggttttaggtctaacatttaatccatcttgaattaatttttttataaggtgtaaggaagggatccagtttcagctttctacatagaaaatgtggcacgtacacaccacggaatactatgcagccataaaaaaggatgagttcatgtgctttgcagggacatggatgaagctggaaaccatcattctgagcaaactatcacaaggacagaaaaccaaacaccccgtgttctcactcataggtgggaattgaacaatgagaacacttggacacagggtggggagcatcacacaccagggcctgtcatgtgtcccctgtcatgggggagggatagcattaggagaaatacctaatataaatgatgagttaatgggtgcagcaaaccaacatggtacatgtatacatatgtaacaaacttgcatgttgtgcacatgtaccccctagaacttaaagtgtaataaaaaaaaagtgaggggggagtgtgatgttctgacttgtgtttttaaagcattggtgacagtgtggaggaggaattgagttgattggtaaaaaggatgaactgatcaaactgaaaaactagtcaaagttagtgtttcttgacattggttttgaaactttgctctcagtaatgggatcagtaaatatgattagtgcccttataaaagagacctcagagtgctgccttgcgccttgcaccatgtgagaacacaaggagaaggtaccatctatgaatcaggaagcagcccctccccagacactgaatctgccagcgccttgattctggacttccagcctccagaactgtgagaaataaatttctgctgtttttaaggcacccggtttatggcactaggttgtagcagcctgacctaacacacccattgtatctttacagtaaaaagtcaaactgagggataaaaacttgatgatgttttcaggaatatccaaccaaaaaagtggccatttcctcatccctgatagaagtttttgctaagataaaaaatgataaacagttttaaatcatgggaacataccaagtagccatggttggcatcactggctaaaaatgcatctacaagaactttgaaaagcagatgaagtagccagatgatatgctttaaaaacttgtaaaatcatcctagaatatacaaagcttaaaaatgcatgaagtaagagatgagaactctccaacaatcttgccattgaaaaattgacttaaacataaaaaaaataggttaatgaaaaacactgccaataagcagatcaaacgtaattggctgagaatgaggggaggaaaaactaaaatgctggtaagcctataaaagttgtaaaactatgtatgcccaattgcaaacaaacaaacaaactcaaactcctttcccagaacttttaaaaaataacagaagagaatatttttacggtacataagcaatgcacaattgcctaatggtatataaaaattgctaattcctgaaaaacctgtgacttgaaatatacatttttcaataaacttttatttgtcaaactcaccaattctaaatcttgttccaaacccttttctttccttctctctttcattacctccctccctccctccctcccttcctccctccctcccttcctccatcccttcctttctctcttcctttcttgatagagtctggctctgttgcccaggctggagtgcagtggtatgatctcggctcactgcaacccctgcttcccgggttcaagtgattctcctgcttcagcctcccaaatagctgggattacaggcatctgccaccatgcctggctaatttttgtatttttagtagagacagggttttaccatgttggccagtctggtcttgaactcttgacctcaagtgatccacctacctcggcctcccaaggtattaggattacaggcatgagccactgtgcctggccttgcttttcttctttaaactagtttttcttttcttaaaatatttgttcagatttacatagtggactcgtctctatgtctttgtttagattcattcattcatttgctgtgctgggtgctgttttaggtactgaggatactgcagagaaaaaagaaggcatcattgcactgaggaaattaggagatgtcagtttaccttccatcagctctttcacatggccattggcaaaacttctaccatgcttgtatctaatctgctcctttgatgcatagattgagtagacataattcactgcgagctcttcctcctgggaatgaaaaggagcactcacaagttgccttattaaagtctttggctaactaatcaattttttactgttaaacttttataagcaccctagggccaattatctctatatttgtaccctattaacagtggcatcagccacagaaagaaagtaattgcatctttattatctttgcgtatagcaattcgtattattgggcaagacagactgacaggatcttgaattttggcttaatagtggcctaaggagaagccatttagaaaatagctttgtgaccttgggcatacttttaatatctccagaccacagcatcatcatctgtaaaattagagtgttggaccagctttctgctaaaggctatgttcacacaaaagtcgatgaatcttaggcattctggaggtttataagaaaagcaaagagaaaatatcactctcattataagtttgcttgccatgaaagctgctttcctgactgatgtttctgaaaaggaaataaaacagagagggagccagtaacctgtgagtgatcagtttgatgctgcatcagactagaatttacccctgtcattgtctccacctgcccccatggcatcaggtcctgaatttcactaaaaatggcagggaaggacaaaccaggagacacagggaaattagaagagataattatggatgatgtgaatgaaggaagtaatatggaaaatgacactcgatttcctaacaatatgagattgttctccaaccattagggtcagacagggtcatttcttgagtgaaagatcagtctagataccacaggaagtggtgttgctaattcagcatgtggcactttatctactgaaacaaagccccattttaagagtcataaagatgggatttgggttgtggctttgtatatttgcatacatatgcgattggccaggaagtggaagtgggaggtgaggctgcccaagcattttctcctgaatgtcctgaccaaatgcagctttgaatactgacattcttttacctacttatacttcctcagcagtttcctcgcattttgcctcaaatcttcaaagcctttgacaatgtgggcttaaaaccatgaggataaatgtgttcagattcttttgtggcaatgcctgctgcgagatacctgtggtcactctgcttcctggtctgggttagtggttcagaactgagtccactgggaagaatggcagctgagtcacaaatgtcactgattattcaaaacatctgtacagtgtaaatatggaaatatcttttgtactttccaattcacatattcagttttgaccaggaagtagcttagtctcttagagtatctaacttttagtgaatatgcattccaagaagcgtttattgctacaatacacaggtgaagtgttattttagaaagactgagactgttttacctgatggacaggtgatttgactgtaagttaagagaactgagttctgggttctagtgttgagccacctacaaatgagctctgtgatcatggccaagtcatcttaacttgaccttctattattttatccataaaatgaaaggattttgattggactccatgaaggccttcaactctaacattctgttctactatttcttacacaagagctctttggattctggacatatgtattgctctagaaactcttgggagccaagtaaatgtttaaaaactcaaatttctgtatcctgttagaggaatgctcagggtgtgtttgtgtgtatgtgtgtgtgtatgtgtgtgtgtgcgtgttcatgcatgtgtgtgctcatgcttgccttaatggaatctggatagatttagttgacaggaaaattttctaagattttggttttacagaaattcttttcctcataaggtctttgttcctctatggggttttcttttgacctttgaggaaaggaaggcttaacttggattgctcatctgtgtcctgatagtgagtgcttcagtatttgaaggtcagcttaatgacccaaagataggagagcagatgacatgtaggtgcccgttgtcatgccagtgatgggggcagaatatctgtttgcatccttctgactgttgctgcagacaccactgaaaaggatcttcccgagagagggaccttgcctgtactcaggcttcctctcagtgtccctgtcctccccctaccatgggaagggaaagactgaagattctgatgatgctcaagtaccctgctacatgtcagagaattatatttgctcctccttctccttattataatttgacttttcttttctcaaggaaattgccttcttttgtcatttattctgttatgattggattttttcccctgcttgtatcatcagaggattggtcaaagtggaaatctttcagcttcttcaattagcgcttttgcaaaaaaaaaaaaataataatgctttaggttaaaagaaaaaaaaaaagccctaagtcttcttttcctcctgggttgatcatgttccattttctgggtcatttttctcagattccttcactgttgaactgcctgaagtctcatgaggtgtttggatgtttcaccttgagtaaatctcaagccataatattcattgccattcctgatctggccctaaacttcctttcccactcactttcacactgtgcttcaaacaatcctgcctctttgcctttcctctgagcactcactttctcctgccttcgctcttactgattcctctgcctatactgctccatctacccagcaaaaagtttcttaaagaccttttctgtggagtcttcaataatgctatctgttatccccattcactggttgtaagtgctttctgaatgcccatacatgttttgtaatcctcctttgaccctaatcacattttacattgcccagtcattaccatctacgtggtactactctcacattagattgttaattctttgagggtaaacatggccttcaccagtgtttgctggttgaaataacaaatgtttgttcattggcaaagcatttgaaaagtgtccatgtgaaaaattgttaaagtaatcacatgattacaacagctgatgaaatttgaattaggtctatggattaaattggtactattgcattaatgttaaattttttgtgtatcattgtatgataattatacaagtaaatgtccttattcttaggaaatgcacactgaagtatttagaagtaaaggagcctaatgtgcacaaattacccttaaatgattacaaaaaacatatataatgtgtatatatatatttacacaatgtgtgtatacacatacaatgtgtgtatatatatatacatacgcacaaacacacacattgcatatacatatatatgcatatatatatgtatatgcacaggcattctttgtggtatttttgtaactttcaagtaaatttgaaattattttaaaataaaaagtttaaaaaattaaattgttatttattactgatcagggataatcatagaaaagtagcccaagtgcggaaaaataaaagaaacatttatttgtagatgaaaaagtaacccagtgaacagtctgaaattcatttatttaatattttataagtgacctacacacagcacatgatgaactctccaagttatgatgaggcaggtcaattcttctagaaagtcacatgctagatgactatgcctaaatggccagataatctgggatggtgccctgtgtggaagaatagcagatgtacctcaaagtacaggcattgtgaggttatgccccttggcacaaaataactcaaactgtgattagaagatgatgagctcttgccaggagttacaatgtagagaaaagatttcagaatcattgcaggtggttacttctgtatgttaatgctactaaagatgccaatgaaatgatgggcattattaggaggtattttggaagtaaaactaattttggtatgacatacttaaacataggcatattggttatatattgctgcttcacatgaactcaaaaattagtggcctaaagcaacaaagatttattactcacagtttctgtgggctaggaagttgagagtagcttagctggtggttctagctcagggtctcatgagtttataataagtatgttagcaagggctgcagtcatctaaaggtttaacaggggctagaggatccactcccaagatggatcactcacacagctgttagcaggaggcctcagttccttactgtgttggtctctccatatggctgcttgagcatccgaatatcatagcagctggcttcctgtgaaatggtgttcaaagaagtgagatgggaatttcagtgccttctatgacctagtttggaagtttatcatttttgtaatattctgttggttatagaagcccacttattcattgtgagaagggcttacacaggcagggatcattggaggccatcttggaggctggctacaataatagggtataattatggttgctgtagcagcgttgaaaaaaagaggaaaaaaagagtgaactttataaaaacgctaagagggcttttattttggtggacaggccaggaaaattaagactcttaaggttgagaagaatgagtagggatgttattgaagtgtatcaaattatgacaaatttggaaaaataaatatgattttattcatcaaagtttggaacaagaaatagtgtttgaagtttctttctctaataaaaaagagatgtaacttgttttctcagtaggaaataaacagattgaacccagaatatataaccaggggattcagaatgctttaaacccaaaacagctctccttgatctctaccataatttctattatttctcccagtcctgctgattctttctctcattggtttctcacatacttccgattcctaggctaccaccctaggaaggtcgttccacttcacacgtgagtgcagtaacctccacactctgtctttgcctccaaaggatttggtcccttggttggtttttgcacaccttctctgttaatctcccaaacacctctttcatcaaataatgcccttgctcaaagacttcaagtaaattctactgcagagaggaagaattaaactgaaccccttagcttggtgctgaaggccctttatcaccaccaaacaccaccctcctttctagcgttacttctcacaatctgttataaaaccttctgctctccaccctcaaggcttggctcttatctttctctttgccttgtggcccctccttgagtttttatttactcagaagcttccttttatccaggtgtgatgctgagggctggtcacaggcattgtcgccatcagccaggcctgttcgtatatctgctcttacctgattgtctgacttccagggagacatttaatctcagtattccctgcatggggataatagaccttctcctgtggactcagtgaggtttcattgctagtgtgaggtgccactcagtgatttctagtttcctttctttttcaagtccctgctcaagtttgactttcttcatgagccttcatagctcttgttggcttcctctcctcttaaaactctggcaagtcatctctaaacggactcatttggcaaataatcatattttgattataattttttccttagtagattttaagctattatgggcagagactgtgctttacaagtcacaggagttgccatagtttcttgcccttagatctttaatgagtattgtttgtagattttttccctcatatgttgtgggtgatggattcacagagacattgtagaggattttccagagctgatgatgagtgaattaccagggtcttccccaaattatcccttaacaccacctatataatgaccgtggggttggctgtttaggtaggtagggccacgtctctgttcccatagcagcttattctggtcttaatcatggtgtgcatcatgctgattgaataggtcagtttgtggccattttccatgtggggctgtgagctccttcgggatagctcagcactggacattgtcagtgacttgcccagtttttgtttgatgtgaagtgcccaaagaattagaaccattagtaaacttcacttcatgctaatgtttagggatttttttgtggagatggggcttgtttataaaaccattttaagtttataaacagatttgagagtatatatatatatatacatatatgtgtgtatatatatatatacatatatgtgtgtgtgtgtatatatatatatatatatatatttttttttttttaagacagggacttgctctgccacccagctggaatgcagtgccacaatcacagctcactgtagccttgaccttcgaggctcaagcgatcctcctacctcaccctatactccacccctctcagtagctgggactacaggtgcatgccaccaagcctggctaatttttttttttaaataaggatgtggtcttgctatgttgctgaggctagtcgcaaactcctgggctcaagtcatcctcctacctcggcttcccaaagtattaggattatgggagtgagccaccgcacctggcctttcttttattaatgctggtaggcacactcatttaacttaaatgaatactctgttcctgccattatgtgatttaatttgatttagaatatgcttgttgtgggtttgatgttagcaaaatgacatgaagccctcaaaacaaagtaaatatagcacttgtactgtttgaaatgaatagtcatacctggataatatgttattagaataactagccttgctcagtgaacagagaagtcatgctaatgccttaaggattcctttcatcagcaaactagtatttccatggaagtcctcatctgagattgttctcagggcaaccagcaagcattactcatcctacatctttaatgcactgaagctggaccattgcttctctgttcacggcctcaaagctccaggaagaacttagcacactgcctctgccggcctttctgagtagtttgaggaacagtgagtacatcctttatagataacacgatggagtggtcaggtgaaatggatggctcttgttgaaaagtggctattcttaatcaataaatttgttttaatttaacttagagatatgtgagagaatcttagcgatatgtgagtagcagaaaatgagcttgagaaaaaactggttgagggtaccgaagttatttctatgtgtgcacttaattgattctaggaagaaaatagattttggagccaaaaggaatcatctggaataattttcccctctgttgtttcaaaaataaattagtaagtcaacaccccattatttatttctctttaactcaatgataaagaaactactgcttatcatcagaactaagactcatccattgtaaggattttattcatcctgattatttactgaggcttttgtggtagaataagcaaagcttgccttccaagtggagctgcaaaacacagacagcaagggttaactctgtgggctgtttccctttctaataggagcactttagcaatgctaatcagttgtactgattttgttttgatttttccataataattaagtgaatgatctgaaatgcaatcaagtttggcactagggggttcatgcaaatgactctttatttttttacattttaaattttgttaaacggaatcataaggaagttatttgaagaggaagtctgagtgggtgagggtagccaacacccaatttagagatttgaatatattcaaaatgtctatcttaatgaagcaaatcaccactgcattgcctttgttttcaattgaaataatactatttttaaaaaattgcattttgttttcatttgcattccaaagtggaaaattataagacaggatgacacagcatagaagagagaaatgaggaagaataaatttactggactttccttcttcagagtaggcatagtggaaaaagggtactcactatgtttactcaccaaaacctatagaagaaaacaaagaagatagggaaaaagtaaatgaatgccctatctgctgcttttttcttttcttttcttttctttttttttttttttttgagatagagtttcactcctgttgcccaggctggagtgcaatggcacgatcttggctcattgcagcctccgcctcccaggttcaagcaattcttctgcctcagcctcccaagtagctgggattataggcacctgccagcatgcctggctaatttcttctaatttttagtagagacagggtttcaccatgttggccagggtggtttcgaactcctgacctcaggtgatccacccgcctctgcctcccaaagtgctgggattacaggagtgagccaccacgcctggcctaaatgtcctatcaacttctgattttgattgcatctcagtgcctttattaaacaagatagaatgaaaggacaatccatgtttcctaatttagagaaatgctgtgtttcttagttctctacagcttattggcatatttgtgagatgtcttctctcctcatcgtctataacatctgtgttattttctcaaacagttttaaccagcttatgtgaatttgcatgatccttgcctcttgatcaaacaattctttttggtttttcagactattctagagctcagttaattttctaattttaattaggaaaacgtattgggacaaagataccaagtaatacacacatacatccacacatatacacacacacacatatttttcaatgtactgatattttttctttcaaaaatggtacctgcgacttttcaatgcagtttgatatttctgtatactgaacttccaaagcaatgagaaggtggccaaattctgctttttctctgtcatctcctcttcacagggcaatgcatcagatacaaagcaagaagagaaaccagaagattagtgtcaatatttttacattaaaataaaactcacaacctctttcttgttctgggactttgattcatggcttgggacaatttctaactttatagactaaacatttctaattggtaaatggatggtttgagtctgagatgactcaggaaataaactttccaatttggggtaattgtttatgagtaggttactgcttaccagccttcatgtctttgaggaaagaatgaaagctaaacacatttcacacttcgttgaagggaaatacttctcacatagataaagcaatgagacaaggaaataattgccatgctcatttgttacagccaaatatattaaagatttttttgatggatgaggaaaacactagctgtatattacacggcttcaactgtaaaacagggacaataaaaactactacttcttagttaagttgctgtaaggattacatagataattcacataaatggctcagtactgtgtctggcacacagtaatcggtcaggaaatgttatctgttattgtttattattatcatcatcattttttattcattccccttaaatgaaatagcttctttatataatgttaagcttcagattttacaacttcatgatgcatgtgagaaatgtcaataatttgaattaatctataagttaattttggttaactatttacgctttatctattggaattatttagtgaccattgaaatatcctttttaagattttacagcttctttaatggcttacacaatatcttttaattatactacaaattcatgattttttccttattccaagtcaaacattttcttttagcctttgttgagtcagcaataggtaacttgtcatagtatacttaaagaatcttgattttgaagaatttaatatttcctcatttgatctgtcctgaatttgaatgataaactatttcctaaagttgtttgttttttgctgttattgttgtttatttgtttattttaagataaatttgccttttcaagccataaagttattattcaatacatttggttcccaaatattaaaaacttcttggcatggaaaatgagtataacttcttaaaatgccagctcccacccagaaaatcactgctttgctcaaataatctggctcattattactagtttcactagtttaccaacaggcaggttggcacttattttgtttgtaattaagaaatggatcagtgatttctaattttgtatccatttttataatgattagatgacatagtatgacaattaaacttttccttcttactaaattccagaggctgcaggagtgcctgtgattctcaggtgcaaaccattacaggtgttacacacccgggcctggcgcaggtcctagcatatcgtatgtgttcaataaatgcttgtaggtggctttgcttgatgatatcagaggaaccttcaacttgacctatctaaactgaactgaaagcttcccctccccagaggagggcttctatgagtcccatatcagcgaggggctaacaatccccacaaggggctaaaccagaagctcctcccctcccttaatccatgttcaatagacaagtcctgtcgattccgcatcctaaaaatctcccagagccactccacttcctgcaaccccattgctgctgccttgatctgctcacagtcatgtcttacctggcctccctccaagagcctccccttgcagctagagtcattcttctaatgccactctgcaccatttactagctccatgttatccttggatgaagttccctactgcacaatggcttatgaaacccattgcgactcaccctctgtctctttctccagctgtcccctttttcttgccatgaattaacttgaactccctaaatgcacctggccctcccttacatgtggatccctctgcctggaacattcaccctcttcaatctcctttgccagcctatctattttccaagcttttaaatgttactttacagtctttaggttcattttctctaacatcgacctgcaaacagctttacatttttttctatgtataatctagtttttagaaacccctgtgagatgtttggtttcatttctgttcagcagatggagaaattgaagcactatgtttaagaaacttatgtcatgattactaagttataagtatcttaacaggcagagatagggactggttctgtgttttatatccagtctttgaatgatgactaggatggagcaggcattcagtgcattgagtgacttatcaaatgaatctcagattgagcctgaggtacctctctcttgattcgatggagcttctgtttcatcatttattttctagaacaaatgaggccagctacctctgtgtgccctcctcttctagaagggaaatatgccaggtgagagaatgtggaggcttgtgttgctctgaattgttctggtagatttctttaatattggctggcataaatgagaagggcttttgttcttgtggcaattgatgatgatttgcatattttagtaatttacaaaatagtagccaccttgcacaacataagaaacacccctctctcctggaccatggaatttggtgacctggctattgaaatacatggcttgttatgcacatttcagccccactgacaactggtacctggtggttgctgtactgaaaagaattctgtgtgagtcatttcaatgcatttctaattgggattttttctttcttgtaggttgttcttcagaaaaaaatggttatttctttgaactcatgcctgagctttatttgtttattgttatgccactggattgggacagcatcacctctgaatcttgaagaccctaatgtgtgtagccactgggaaaggtaatggttttgaaaggagcctgacaaagaattgctgagaagttcccttatatactgtaattatcagtcagatgtataaaattagaatttgtgaagagattgtgaaattacttttatgtaaaaatcattagtcatagctagcaaattaggtggtgttagtcaccttggtcttatagcatatatattatgtgaaaaaagtcttgatatatctaattctaatgcaggtgcaattgtaagattcagggaagacattaatagcacaattaaaagatcttcctaatgtcttgtctctgatttgaatttgcattaattttggggagctggacttatgcatgggaacccatgagtgagaagtggaaagcagcatgagataatatactaaagtattgaaatatatgggatttaaaagaattttgctgtagatggcttgaaaacggagacctaaatttggtgtaaactggcaaggctgcatagaggtagtgtcccctgagatgctcttgaagaactgaataagatgagtgggttgcaatgattggaaggggatcttggaaggggagtcagtttggcagtttgaaatcagtgccatgtggaccaccgagaactgtgcacaaccagagcagagttagtaccgtattggaggagggtgtggttatgtgaaggcagatgatgtaatgtctagatatgagcaatttgcagtagaaagtacaaaacagtagatcatcctctgggactttatagtcccttttggaacacaaaaatagtgcaaacccatccagcgatattgcagtacaatcaagtccagttggctctgctctaatgtgctacttgaatttcccagaaattatcttatccaaaaactgtaaatgcaagtgttttaaacaaagagaagatgttaagtactggagggtaatatgtatttttaatagctgtaagtacaattatatcaaactcttgatcttcagcaccatgattagcaaaccacagagcacacattctaatcacctttgttccccactgttaggatgcataaagcccagagcctctcaagcacagcagtggtattattctggggacatgctggtttctcactcagtattatttttggtaagggcttatccctacctccattggtagtgttacaagcagggtaattaaaacataattacctgattagtcaatggagttatatattattatgaaactttaagctgcagagagaatatatgtatataataaagttctatatatttgtggtattaactacattatacagaatttaagcagaaggacttcctattagtgctctttataatatttacagcacctcccataaggcatttcatcaataaaatatataataaatacttattaaagtcatgaatcattggctacatcaatgggtacaggtcaaatttagtaaaggaagagaccattggtagttgaacttcttggagggatgatagatttgggatgggaggaaaagtcaagtttgtgagatgttgtgaaataagaatcaacagatcttgataatacattgactgaggaagtgaaggaggcagagaagacgaggatttagaacttgctgtgtgaagtaatccagatgacattgcgcatatggaaaaataaaagaaagagatttgatttgaaagggaaggggttagtgtgggtttgccatgttgtgtttataaaatcagtttaaaatatgggcctggaagtatttgggaatatagatttgggaatatccagcatgatgagatgtgagatgtgaacagaggaactctctgagggaaagactataagagaaaaaaaggttgggtgcggtggctcaagcctgtaatcccagcacattgggaggccaaggcagatagatcacttgaggccaggattttgagaccagcctggccaacatggcaaagccccatctttactaaaaatacaaaaagccaagtgtggtggtgcatgcctgtaatccagctacttggggggctgaggcacaagaatcacttgaactcaggaggtggaggctgtagtgagctgagatcatgccactgcactccagcctgggtgacagagcggaccctgcctcaaaaaaaataaaaataaaaataaaaaaagagagagagagaaaaccatttcaaggcttcaaataatccggcacccacttataaatacacattttgtcctgcttccctggtcagcagttgaccagagctgccaatgcataagtgcattgtctggctcaccactgataattcccactgtctaaaacactgccttgcatgtggcatgtgtttaataaattgttgaatgagtgagttcatcttctgataggaaacgaaatgactaaatatgtacatcaatgtgggaggggcatggagagtgagaaagacagatagacaaggggcacattaatctctaaacctaatagaacccaacaactgtgcaagtgattagtgcaaactctaaaatgctcatgaagggggagggaaattgaatgtgaacaaataggaaaatgatgaaaaaaacttccagtttttttaaatgtactgccaggaagaagagttgacagctataatcttcttactgataaattttctgttgtaaggctagataatgatttctagaagaaaggtaaaagaaagtagaattgttttgataagaatggggaccagtatagaagataaattaaaatgatcaaataaaggcacaggtgacaggttcgtctagtattttcaaaaatgtaaatgggcttgaactgaaatggggagaggaagatgagctccaagggcataattctggtagtagggctcattttaagctcttcttatgctcaaaaccacctgtacccaatggctcagaaccatgcaatcacctggaggttacttctcagactgtggtttgcagagctgaggcatgaacttgttagaaatacagactctcaggtcccaccccagacctactaaatcaaaatctgcattttaacaagatcccagggaggtttgtctgcatattcaagtttgagaagcactaaacaaaaatacttccatcaatggcttctagctgcatcccaattgatatctgaatatttattttgaaatagagatgtgccttgttttaatgcagcgattgtgattctaagaaattgtacataaaatgaaattaaagaaaatgaaatcatttaaaatactcaaggggtgtttatgattaaaggaactctgtacagtgtctttttggaaaatgaataactctagaaattatctattccttctcctaaccttctttctgtattctatgaatttgagcttttccattcagtggggtttcttctaaagaaggcacaagtgaagagaaaccacactttgaccaaaccttcaattactaacacagaagggagagtaattgaatcagcagtcctgaagcaagcagagataagaaatgaagattattaccatatctgattaaagtaacaagataatttaggcaggtaaaatgtaattaaccactttggaacgtgcccaagtgataatgtcttcctccccttattctccatctcctcccccactccctggttctttgaccttaaattaaatcttgctggggtttctccccagataatacttaatagattaaaatcacggcaatgatatattttcagtatgtttgagaagattaaacaaacaaacaggaaataaagagttttgcctctgaatgctgaaagttgtgcagaattgggatcagttttttaaaattccagtttcccactccttgtctgttttagaagctttaaatgttctatagtgatgtttgagagaggatggggcaggacagtgtctgagggtcttggtgttactgctgacgctatatggaagctcagtgttgctcattgtcaatgaaagtaggattggaccagataatagaagtggtgccctcacactctgtgacttcaggagcagctgctggtgaatgtggaggtatggagtgttagcagaggaactaattaagttccatcagcagcctaagcactggccatagtggccgtgataaagaccagaggaggcaggcccattcttgaagacacttttcttcatgattcaaacacatcgcttccagaaaatggaccccttgaagaatgacaacttaattgcctaatgattggtgggtattgagcaaaataggtgtagtcacttacaaagtatttggcagtcataatttgaagactatgtactaacatgggaaaatgcttatgatatactcaagttaaaaaagaatgttttagaaatatgtgcatggcatgattattataacctaagaatttagaaataccctcaaccaaaaactaaaacctcctggaaactgtaaagaagcacaacaacatgctgttggtggttatgtgagagctatggagttctgtctcttgctctgttttttaaaaatgtgttttccaaattccatagtgtgattataatacctttacaaatgaaaaaaaggaaaaactgtatagaaagaaaaataatgtgtaagaaacaacagaaaagaaattcatgttgaaaaggcttagtacctttctcctataagcttaagtggacgcttcagtttctgaccgatgataattaggcaggtaattatcattggtcagaaactgaagcgtccacttaagtttatacagtaatttaactatagttaaattagttgaactgtagtttaacatagttaaattagttgtactatagtttaatatagttcaaaataatttatatgcagtcagttctgtactgggtttgagtgtcaaaataattttaatgagtaaagccaagattgaggagaaatactcaaaacataatgaattttatactcctatttcccccaagctatatatatttctccatggaaagctatattgtattactttcagcatttaaatattggtctctcattaggttgagagctccttgagggcaggaattgcatagaagttgctcaataaatgtttgttgaattgaaatcctaaatactttgattgtccttttaataaaagagctattggtgagcagcaagtgacaagaagaggaaatttatgtactccaacattccctctcatttaaaaactctttttggttcctagaaaccagtgaaaacattttacttgtttgcttatggaattggttcttccatccacatcaaatagaactggccaggatgcatttactgatgataacattttgcactccaaggcacacggacttgaatatcataacatggcctttgaaattttctggaaactctgtatcaggtctagttccaacaaatgaatttagttcagctaaattagtactgtagagactggttgaataagttttttctcccaactggcattaatttagagtggcttcttttttgttcttatagcatatgtggtaagttgctctattttgctcataggtgatgtaggactgtacctgtacaccagttgtatacacagaggacgttcattcactttgttctccactagaaatggaacagagatataatgctgtaggccttaagattcagctatttacaagcagctggatagaaagtgtcaactttaaacaatgagagtcagaaaatatgattaagtattgagtttattcgggcgcaaaatttgaggacggccatacagaaaacagacttcaaaggaatgggctcagtgttcccaagtggggaagttaaagtttcacctatataggcagaaacagagaagtttagtaaggttcgacattttccatagaaagccagtacatatgttacagtgatttgattgattacagtttgctacatttcaaggaagattgcttcaacatttcatgaggaagggtaatgatctgagggggtcttatctctgatgccatttggttatttctaatcatttataggaaaaagaagttgcagctgcctgctgcatgactcaggccacatagttatattcctctcaaggctcaaaataatttaaagttccaatagctttaaatttgaattatttaatttcacaggatgaaaaaatattggtaaggaagtcttagaacctcaggacaccgctagggttctgaagaaaatacagatagcttaatgtgatatgtcattccaagaatattaatattttagcaggggcctcttgctttacccaaaagggttatatcatagcatgcaggcatttgcacactgtatcctcatctgaacttatttttgcaggtagcaatgggtaacatttgttggaggtagaaagaaacagtcatctaaagtatatgttagagattcaggatgctaaataagaggggatcttcaacaccatctctgactccttttattttaaaacgtgatcatgaggacccagggaagtgaggttatctgctgaacatctcccagtttctcagtgtcagtacagaattataaccttctaatccagtgctcttttcaacagagcctgtttcattgcccaacatttatgaagggtccctaaatttacctagaaataaattgcaatattccaaagaatgaaatacacaaaactatgaatagtacgattacttcatggctgtcctattgaagcctgatacataatgactaccagagaccagctgcagaaagaaaacccattgtttgtgaggctagcaccacatagcttttcaaatgagaaggttctgtctaacctgaattcttcatgctggcattttaacttccttccttcctattagtgaacttgggctattgatttgcagcaaatgagtctgtgattatggcccatttttttgtttgtgtgaattaaagattttactgaaaatctttaagagaattaaagcaaatagaataaattgtttggagaagattatccacgttttcttataggcagacactaagctctttagcatgtaatagactgtttaaaatgaagaagtctggaattcaacagtgagtattcttcatatttcatggatgttttccacccatgttcttaggcccataggcttgtatgttttcactctaagaagaacctgttagtgaaaatgtattggaaaacagactatttaagtagtagcaagctgttggtatgattattttaggctaattgtctcagccatatgtttagaaccaggtttaaagactactttatagtatttatttagttgttgtatactgtatagtcttccattgcctgaaatcaaattattccaagttccaactagagaaaaatatgttctttctgatattttaagaatcagtagcaaaatgcactctattactttacttgaattgtttctttgctgagtaacattatttgcatgcagacttagaatgaaaaccttctgtgaatgatctttgttatgctttgagccctggggtaagaggagggaattaaatgcagaaaaatacggagtggtatttttaaatttgggaatattagggtttatagtgaggagtaaaagagaattttctttaaaatttacagcacaaatcgttgtattttaaatgtattgttaaaattgatccttttggggttctagtttaaataaaaacccataaaaacatggaaattgtctgttaaaagtcactatggagttgcaaatggagataatttagcttacaaacttttaaatacatagtatattattaatttaaaaaagagaaatactgatttcttatttttccatttcttttcagctactcagtgactgtgcaagagtcatacccacatccctttgatcaaatttactacacgagctgcactgacattctaaactggtttaaatgcacgcggcacaggtaatagaagctcaggcatgtttgtgagtttggctaactgggaatagattctaatacagagatattaatgacagcagaaagtgcatccattcattcagtgaataggtattgagggcttgctcctgtcttatttttgtgccaaatcacaggggatgtagaaaagcagaaaggtagcccatgccctaaaggagcttacagcctaactgcagagaaagtgtctgctgtttaccatcatttgttaacaagaattcatctagcctctgtgttgcgcataactgggggagacactgttacctatggacagcagcagatgtcaagcaattcatatcttcgcatatgtttccagttgaacatctgactcaatttaggctaacttaaatttgacccttaagtaaaacaagatgtattttttttctataaatgtgaacacagaaacaaaactaaaatataattaaatattaatgttaatatagaagggaactctgatgccctaattttattggtagtatactaacatttatagtgtatgagttatgccttgagtgcagcatctgctgattgtactgcactaaatgatgttatgctcaatgtcatttcttcacacaagctggccttggccactctgtgtaaattagcatttcccgcctgtcacattctattccctgactcaggctttatttttcttcacagcatgtaatcattacctgccattatatgatctaatcatttgtttaatgcatgtccttactttaacaaattcagccagatctgtcttcccaagtaaaatgtaagttccttgagagcaagggatttgtattgttttgcttactgctctttccccagtgtctagaacagtgcccaggatatagtaagtgctcaataaacacatgctatgtaagtgaatcagtgaataaatggcactttagttcaatggagaggtcttttgtctgttagtcttctatattataatgggatgagactgccctaaggtttttaagggaattctctgaattcttcctttaaaacatacgtaagtgaatgatgctttgatgggtatcatatatgaattaatcaatacttttcaacatatcttaagataagtgaaagagggaaatcatgaaactactgaccccttaaaataaagcatagattggcttcaatagggaatcttaatatcttcttagcaaattgatgagttagtattatattggtctagacatgtattccatatttcttcataactagtttgaaatactttgcttttcagacttttattatgtttaatagctaatttttccttctctatagagtcagctatcggacagcctatcgacatggggagaagactatgtataggcgcaagtctcagtgttgtcctggattttatgaaagcggggaaatgtgtgtccgtaagtaagactgtcacccctttgagattcgctagtttttcccagtgctggtttgcttccattaatagcagctgagacagaggtctggggagatgggtgtcttggaacattccttttccctctggttgctacttttccttggcttgtgtaatgaaggaaacattaactctgtcctcctgtcttatccaaagtctccaaatgaatgttgcttaaggtgaaaacagctgttacagaaagatgattcaaggccggatgtggtgatgtaaattataattcttcaataaatgtctcattggaaattggtcaggactcattggacctgggtcccagaagagaacagagacctaactttcctgcagctgacctgagtcaacttccgagaggccagcatattcttttctggtgcacagaatgatgaggcttattaaatgtagaggagttttcacattaaaaaatgacaataagtctgcatcacaaaatagaacttcttttcattgtcattttccctcttctctaccctccccacttcaccagttcattctgagatgtcttgagagaagtttcgtatcttatgacacacttcagagaatcctagaatatgagatgcatgtgagatgcagtttgcaattgagatttctttctttgtgtataggtcacttagaagagagatcattaaagactattttatttgagtattatggctcaacacacaggtagagggacagctctgctttctgagttgagatgctgatgttgagtagcacagagagaaggttctgctgtaatttggaggcaccaggaatgactggatagatctcagcttaagaatctggaaagcccagtgatatcactggttctaccatcacttggctgggtggcctcagataaaccatttatacgtcttggaggttcctttgctgtctcagagatagggcttggaatagtacatatctcgtctttcttccaacccctggattctattctgtatgcagacaggggcagctccttagcttggattcagaatcagggctatatttaataatacatgttcatagaaagaaaaattagaatatgtaactaagcaaaaagaagaaaataaaaatacgttgtgaatatttttcctggtcagtaattatacttctgtaacatattgcaaatgtcagtatattgttgcattataaatatttgtttaatcaatctcagctgttgaatggtcacacaatttccaaattttacctatcgtaaactactctaaaggacatcattgtggttaaataattgttcatatccttcattaagtaaagataaattcctagcagtagaattgctggattagaagtgtacatattttaagactttcgatgtatttctaatttaaatacccaccagcagtaaatgagaatggctttttgcttataccctgagccaatcttcctttcactaattttttcttaatttgcatttctttgattaataatgatgctgaataagaaaaattacatgtttataatcaaacatcttagagaataatcatgagcagatctcagtggcccaggctgatgggaaattttcaaaagaaagcagtgtggagtacacacaggggtggggattggggaggcctggccactcaggctggccatttcccagaggccttcagtgacattatcttgatgcctttacctgggttcaaccttacaagcacaaccatcaacataccaagagagtacttctgtctcccagcacacatttctattaacccaggggtcatagaatttgtatatgaagccaggatgctattttcctaactcatacaaaacttggaaaggtgcttgtgcctgtcttctggccataccttctctccctgaaggcctggcatgtgggatgctagatttcactggcaagctggtgggggggtgtagatccaagcaagctcagttagagagacagcttcaatgtttcctggcatcagccgcataattcaacacctccgttttttaactcagtagtgcagcccttcttagaaagttaggcaattccactggcactatcacgcctgaaattacatgggtaaaaatacattttctctcctgctagacagcttgcaaagcatcccccaaactgcttgaatggacacctctagcatttgcctcaaaaattctccttttttctaggcctcttgctgaccaactgcccctgagactgcaatattttttcctttagatatgctaatatatttaatcagcttactctctagtctcactggcctggaagctgttggtctctggtctctaaaatattttgtgtctctccactctgatgtcttgatttcattgcttccccacacccccaccccgcccaacaattgttacgcttctttgttcttggaggtgactcccagtgacttttctgtactcttcacagttggcacaagtgaggcaagcttgtagatagagaaggaacaaaaaatacatgattcttgtttgtgttttcatagtctctttttttctaccaagttttgctgccagacagataacatggtcacctttcttaactgtttccagtcaccaagataaattaaacacaggaatcagtcatcatttcaaattaattcttggtagtttacctagaaggaaaacaaggatgatttaatgcaaatacctgtatttgaaacaagtttcttttatgtactcaagtagcaccttcaggagagcaggtcctgtcttcccctccctccccacctctgtttcatcctgccccacccgctcctccatgatagaccccactgtagatggtcattctggaggcttgacatggaactgccagctgcctcaccctctttccacagctttctgaggtttcctgtggggacctgaccggctgtcttcgttatcaagtgttagtgacatgtccttttggttcttatcttcccctcacccactcctcccactttcagagatcagaacacttcacaaatattaaaagtagctcttcattagaaaattgtcagggatatgtttggtgaagaatgatcttctcagggccaagcatggtggctcatgcctgtaatcccagcactttgggaggctaaggtgggaggatccgttgagcccaggcattcgagaccagcatgggcaacatagggagaccccgtctcttaaaaaaaaaaagtcatcttctctaggctccagagactttactgaagagtgggctgccagttcaaagtcagctatgattgaggaaggggagctgagtggcctccaggagccaggctcaccttgtgaaggagtctatggaatagtgccagtctcagaaccataaggacagcttgtagatgtcaccaggatggtggtaggaccatgcagcttagtttaacttgttttgggagaaaagcaggtttctattctacttgtccatataaaggaagtcattgttcctttatcgtagtcatttcctctttcacaggaaaaatcagactcaacacagtagattcaattcaattgaataaaacatgcattgattgacctacaatgtaaaaaccagtgagctagaccctaaagattatgtatgtatatatgagccagacatactttctgccatcaaagagttttgcagtctaagtatcttttttaatgcatttcagacaacaacgaagtcatggttaaatttattgtgtgcttactacataccaggtatatacattatcttataaaatttctaaaacattatgaggcagatataatcgtacccatgttaaagatgaggaaaatgtggctttgagaaattaaataacttttttattctgatcaatcggtgatgagtggaggaggaggatgcagatatttatgctgaacagagaatgagatgctttacctaaataaaataactgaaattggcagagtagcttatgaaccaaggattatccaactcctgtccatgtcacatgttgtcaagaaattctcagctgcatctcattacatgacttcaaatatttaaataaaacatacgtattaaataatttcgacttgaaaaaaaaagttgagaaaattctccgttctctatgttcaattccatctctctttttaaggtgactaaaattagtaaaaatctcttttcttttgaaattggatttttaaaatgttcttgaaaacaaagaactttagagaaattaagtaaatagatcttacacatgcggtgattctgtctacatcgaccagaggactgatcgctgaccttacaggtatcgttagtggatattcaggattgttgttactgctgcagtttctaaacttttgggaaatttagcaaggcagcctagtcaggtgctcctgccttctctgtagtgtcaaggttccagggaaaaggacagtagctcagaaagatcctgaagattttaagtttcatattaatacattgagggccagagcgtcctggagttagtctttcatgtagattcacatggaaactgtcccaggacgaggctctcatttcatgtttatgtgcaatagaagcagcaggtggtcactgaatggctcttcattctgtcagctgtggagattcttggagaaaaaactctagttttcttgtatatagagcatgatgaagagactggctctgcttccgactggaatgagcacacagaacttttggggaggctggtaaaatgcagattctgattccatgggtccagagtggggcccaaaggtatgcatttctactgaaccctcaggctgtgtggaactcctggtccacagagcagactttgactaacaaggctgtctgtccgaaagaccaatgcatgtcatcaggcaggaaagaccagagcagagagtgtgggcaacagtgtggttagaagccttttcttagaatgtgattagaaaaaaagaaaggattggaaattttttaattaaaatattactaggacaggaagaaatctgtgattccttgtggtggttttactctgtttataaatttaattagactctaaatttgttcatcctttaagattaatattcttgcctgatctgtggtaagaatttagacatgtttcattatttttgatttggagatttttcttttatttcaattgttttttaaggaacaggtagtgtttggttatatcaataagttctttattggcgaattctgagattttggtgcacccatcaaccgagtaatgtacactgtacccaacgtctagtcttttatccttcacccacctcccacgctttcccttaagtccccaaagcctatcgtatcattcgtatgcctttgcatcctcatggcttagctcctacttaataagacagaatatacagtgtttggttttccattcctgagtgacttcacttagaataacggttcccaattccatccaggtgctgcaaatgtcattatttaattcctttttatggatgagtagcattccatggtgtgtatgtatgtatgtatgtatttgtcacattttctttacttgttgattgatgggcatttcggcttgttccttaattttgcaattgcgaattgtgttgctataaacatgcatgtgcaagtatctttttcgtataatgacttcttttcctctgctagatacccaatagtgggattgctgaatcaaatggtagatctacttttagttctttaaggaatctccacaccgttttccatagtggttgtactagtttatgttcccaccaacagtgtagaagtgttcctttttcgccacatccacaccgacatctattatttttgaattttttaattatggccattcttgcaggagtaaggcggtatcatattatggttttgatttgcatttccctgatcattagtgctgttgagcattttttcatatgtttgttggccatttatatatcttcttttgagaattgtctatttatgtccttagcccactttttgatgggattgtttgtttgttttttcttgctgatttgtttgagctcctcgtagattctgaatattagtcctttgtcagatgtatagattgtgaagattttctcccactctgtgggttatctgtttactgtggtgattatttcttttgctgtgcagaagctttttagtttaattaagtcccatctatttatctttgtttttgttgcatttgcttttgcgttcttggtcataataatttggagaattttaagtacaggttgagtatccaaaatgcttgagaccagaagtgtttcagattttggatttttttgagtttaggaatattttcacatccataatgagatattctggggatggaactcaagtctaagcatgaaattaatttatattttatatatatcttatacatacagcttaaaggtatttttatacaacattttaaataattttgtgtatggaacaagattttgactgttttgcctatgacaggagctcaggaatgaaattttccacttgtggcttcatgtcagtactcaaaatattttcagattttggagcattttggcttttgggtttttgcattagggatgctccacctgcattaataaagaaatcctcagagaaatgaaattgagaaatgtccagaggaatgaaatagttgtaatatatgtgtgtgtgtacatatacatatgtgtacttgtatatatgtgtttgtgttgtgtgtatacatatatattgtatgttttttaatgtcacataactgcctcttataaaattgctatttatttaaatctcagttcttgtacctaaataaatattgatccaaacacattccaatatattttcattaacacatatcagtttttataataaatatttatgtattcgagagacttctgtggttcttcatgggatggcttagagttaaccaacacttttttgttatatacattaatcctaatgcatgtataggaactatagttatgttagggagttagagaagcaagaagtatgattagtttaaatgtttatggttgagaaatcactggatactattctctgctttcaacatataaccatcatttgactgtaaattcaaatatggacatcctaagtggagtgcacatgaccaatgtatagttttccaaggaaaactgttatatttattatctctcccttttggcctccaataaaaaaaagttcagttcagattgttaacatagaatggagaaaacacatgaattaaacctaggttcaaatcccaaagctaccctgcatgtgtaatgtccctgggacacaacatccttgatttctgtgaacctcacttcttaatctgtaagatgggttctcatgcctattaatcatgtagggttgctgttaggatctagtaagatatattaaagtgttttgaaaaatgcaaaagacttgcatgtacagtattaactaactgaaagtgatggttctggacttgattttagtaatatttgtgatgtttggatttcaattagaagataagaattcttctgctgtagctctaaagttgagtaaatattaagccataagattttcatgaggtttaaagtaattctcatggcaattctttatcacgaatatcaaactgacttgctaaactatgcaccatgatccatttgcttatatccatgtgcttatgactactgtgattagagataataaatatgatcaaatcttcctttctagtcatataaaatgtattgtcttttacttttctctcagcagaagagtgtccctgaaatgaaaaagcctgccttctttttctgattctagctttgtaacacatgtagctattttaaaatggaaatgcaatcaaatttaaatgtagaattatttttatatcaaaaatacttttttgatttttttatctcaaactacaaaggcaatgaatttttcatacaataagccaggtcacccaaatatgctaactactattcagtatttgttaaacgtgaagtttgtgtgcttctatatgtgtaggtgggtgcatatgtgcacacacgtatatgcaatatgaaaaagcctattcagagatttactttgtttttaataattagtatttgatttactatagttataaatccaaaaacatagttgcttcttaagcaaaattcagctggcagatgtttcattcattggtctaacaaatttaacaaacacattaagaagcctttgactaatgttttataaacttaaacaccttcaaatttttaaaatggaattcgtacatttaatagatttgattttcattttaaataattcagcttccaggctgacaaaccttcccatatacttaaataatttttgtaaatctaataagcccaacttacaaataaggtgaaatcttatgaactctaaaatgttaaaatataggctggatgcggtggctcacgcctgtaattccagcgctttgaaaggtgacaagagcgagaatccatctcaaaaaaaaatttgtattagtaagattaaactttaaaataacattttaaaatcaattattccagtatacatttaaagaataaaattagtaagctgaccttttattctacggaccacattctcttaaatattataaatgtcctcttaaaactaaaaatatgaacgctatagattttgattctctctcacatttctgtgcttaactgaaaatcttcacaaggttgaaagatagttaccttctaagcatcacctcataatttttggtttaatttttaatataagtttggtagtctcttcaattcattgaatttcttgatatttatttttatacggtaaaaacacatgacattaaatttaccattttaactatttttaagtgtaccattcagcagtattaaatatagtcccatttttgtgcaacatatctttagaacatttttgtcttgcaaaacagaaactctagactcattaaacactaactacccctacccacctccagcccttggcaaccacctttctactttatgtttttatgattttgactactttaagtccttcatataagtggaatcagacttcgtcctttcatgactggcttatttcacttaccgtaaccataatgtccttgaggtccagccatatcgtagcagcatgggacaggacttcctttttttttttgttttttttaggctacacaatattttttctgaagattttaaatatcagagaacatggtccttgactactaccttgatggatcatactgaacctaccacctgttctagatggcgtacccagtattcattcaatgtaagacatattatttcctagtactagtttcaaattagattagaactctcaatccagttggctactctgattgattaaatttttgtgcatatctttggtcattgagatatgtaaatatttttggcctaagtaccatgataactgacagaattatgtattcttttaatataattcttatatgaaaatcttataagatgtgtggtcctttatttcttgtaaatgttaaaatgatatcccattgcattttccaaatttcacggctatgtttggaagtgaaatcacaacctctaaggtcatcttgttcactctcttccactttgcctttgggctcatctcacatatagtctgaagttacaccagtgacactggtgtagctctttctccagggtgttaatttcatctgcagtatcagcaatctctagacacttcccatttctttgtccccacctttcagcctgcccaaggctccagatagttctctaatttagaattttgaccttgttcctaagataaaaatttgtataactcaagttgtcttgaatattgtgtgtcccaagcttgtctgttaatgtctgttccctcccaattgctgtgcctgtcttgcttcactttctccttcttttctccctgccccttcctgccctccattccttttttcttccttccttggttctcttcctccttttgtctctcctccattttttccccttcttctctccttcctttctaagcagcaggcacaccgaagactgaaggatgagtaaatcactgttgatgttcttcagggctcagtctgtactaaacagaaggaatgaaatacaaactgtggaaggaagggaaagacccctgggcccttcccttctcaactgtgctacactgtttatcagaagtaaaacacctaggccacttcaaaaaagacataaatttgttgtatatatatttttttcattgatttttaaaaaaattttgaagttgtagtttttgtggatacatagtaggtgtatatatttatggagtgtatgggatattttgacacaggcatacaatatgtaataatcacatccgggtaaatggggtgttcatcacctcaagcatttattatttgtgttgaaaacaattcaattatactcatgggggtagagagtagaatgatggttaccagaggatgggaaggatagtgggggtggggtagggggaaaatggggatggttaatgggtagaaaaaaatagaatgaataggatctagtgtttgatagcacaacagggtgattatagtcagtaataatttaattgtactttaaaaaataactaaaagagtaaattggattttttgttgtatatattttttaattacctaaaattatttttcatactgaagctatttttttatctgtgtaaaaaactggaaaacagatgagcaaaaagagaaaataaatcattcatagtcctgccatttttgtttgtatctttccggatatatttccatttctttaaattcaatataaatttgtaggttatgccatgcatattttttgtaagctgctttgttcatttgtattatattgtagacatattttcttgtctatcaattacatctaaataataatcttataattacattttactatattaatatatactaacgttaggcacacgtagttttgcggctacagggagcatcattttatttatccctttgcatgtgtgagtgattcatacaataaattattttaagtggaatttctggaatgagaggtatgcatactgtatcatttagaattagatttggctatgtagtgcctagaagtaggcaagccagcaggggactcaagcagtttttacccttctgctccaccatctctttgtcacatgctctcgccaagctacaagggcatctttattctgccactcctgtaacttcacactacacatggaatgagcccaaaggcaaggtggaagagagtgaacaagatgaccttagaggtcatgatttcacttccaaacatagccatgagacttgcaaagtgcaatgggacatcattttaacatttacaaaggtatggtcttcatttccatgtaccattattgacctccacacatcaacagacggaataggtgggagaaagaggcaaatggcaatgccaactgtttcctaaggaaggttcctagcagtgatcatgttccttttatatcccactggtcacttggtctcaccaagctgcaaatgcatctttagtctgtgtggtcagaggcccagtaaaaatatatataaatatatatatttctctgggaagggtaaaatggatattgggagacaggaataatcttagccacatcttaatgcattttgagacacattgccaaattgctgtccagacaggttgtaacaacttacatgaccaccagtaatgtatgagggtacccacttccttacatttctgctgacctaggtattattattgctttcaaccttttgggtgaaaaatggtacctagctttattttgcatttcctaatcattaataatgctgttcactttaaaaacttatgtttattgctgggcatggtggctcactcctgtaatcctagcattttgggaggccgaggcaggcagatcacctgaggtcaggagttcgagactagcctggccaacatggcgaaacctcgtctttactaaaatacaaaaattagctgggcgtggtgatgcacacctataatcccagttacttgggaggccgacacaggagaatcgcttgaacccaggaggtggaggttgcagtgagccggagccgagatggcgacattgcacttcagcctgggcgacagagtgagactgtctcaaaaagaaagacaaaaaaaaaagcgtttatttaccatttgtattttggctttagggccaggaccagggtgggagatacagtgagactgccttgttcttcagagagccataagaacaatgaatagaagcaacaggggacagtggcaaatgaaagagaaacaggttgatttgggggctgataaagaagacagtttgagagagagactttactaacatatgccccagagaggtcagttcccatggatgtgcccagcagcagcagcaggaggcccaggcccttcctagctcttgcactcatcgacatcacggatgctcattctctcctcaccccatagttccattaggcctcctttcccaagacctcaactgtctgcagtttgcagggatgatctggagccagggaaatctcttgtcttctcctactacctacctctcccatgagcattgtggatagaggaatgatctctgatttctggcagtgaggtaagctcttggcagtccaaactgatatgtgaatggcttgacctatggaaaggagagagactcgtgatccccacatactgtggttcattcaggcacatgctggaataaatgaacaactattgaggttgccctagggacctaaccattatttacaacattataactccaagaaaatttacacaactggtttccaaacacatctttgaaacccgacctcttagcatgttggggactgcttatagatttagtgacatgggacttggaaaagctcacaggaaaagcagcagaagagcagagtgggaagttggcagctaccctctgtgggaaggattggttaatccagagagaaggctggccatacattctcagtcggatgttcttggcttcatctccactgatggcagagaaagcgaatcattgtaagcagcgctgcttgcagcagaatcgtgaatggacaaaggagatggccaggggtcccttctccagtccagctcccattctctttgccccacatgccttgtcttctcctgctggatactgctgtaaaggaagggactgttctgatgattattttctttggggtagacttaagtctgctaactctgtttttgttagatggagaaagtcaaatggtaactcaaagttcaagttctaatgggggcgtccaggcaagtgtggcttgtaagaaggacagagggaagaggtttggggactgggtaactcactttattgcctggcaggccagctctgatggtgagagatcagttcccatggatgtgtcctgcctgtcgttggcactggttaagagaactttggaaccgtaaataagaagccttaactcccacacactgaactgtgtatgatttcctgttcttaacagaaaggagtgtgacaattgattaccagagcagtgaatgaatattcacagctgatttttaacttggccaacttcatgtaaaactgaaccggctgtgggcagataaggagctggaactgtggttggtgtctatatgaaaaatagttctgtagatgaactttactcttgtttgaatgtcatgcttcagaaaacaatgggttttaagcccaaattttgaggcgagggcttaaaaaacacctgcagttcactaacccaggactcttttccttccaggaggcagatatgctacacaggtggcactttgggagtcacaataactgtttgccatataatacgttttcctttatttcttctttttaaaattggaatattatgttattttagactggaattaacaaaaagctttcttttgggaaagggagtgctacctcttggaagtggctgcctggaacattgtgtttagaaggattctgaggctgtgtctgggctaagagagaaagagcaaagtgactcactagtgatttctgccacgggattggagtggcagtgggtggcccgagtgcgcctcatttgccatccctgtatttgactgcatagtatcctgtggcattctggaatcatggagatagcaaccgaggctcctgaatcacacacctggctaaaggctcctgttatacctacctctgtcatttaagtgagaagttatatttactgttcttgctattgtccccagaaaaaaattaccttcctttgtgagctggaatatttgacatgcttaactcgggatcatattgtcaacagttttgtgttggggatgggaaaggattttcaatggctatgttttgcctcagtgtcagccacaggggggtctgattaggagagggattggcaggcttgagcaaattgggcacggcttctgggaagagctgaactgaagatagtttctttccctaccttacaattatgtgaggacacatttaattatttatcctggctttgtatcattttggtcttttcctgctgaaaagtttagggcccagattctttaggctgagaggagctgcagtgcagggaagatgccttgttttggggtgagaagagttagccttcggcagaggtctgtttaggggaaagctaggctccttgggtggatttggggaagcaaaaggagagcttcaggaaaggaggagtacctcttattggagtttgaggcagacagagccttctgttttggatttgtttgattctctcaggcttgtttaatgataaaattgtgatcttgtcaaatattaaaaaaaaaaccatagtcttttgatccatttaagcagatcctttcgagtagagataaaagtgagacaatcctgttaagctagtcaaagagagcctgactgacaacaatcagatggtatgttcccaaatatacctacccatgatgccctccctgccaccggcattgaatttttttcctgtttccatagggaccctgtactctgttgctatggtgtccgacgtggttcagaggaacctaccagtaaatacaggggaaggccttttgtccacataccgtgccagcagaaattccaattttcccacacatctatcggaacctaaacttctgctttccagtttgggtcgttggtctctgctagcagggaagataggaaatctaataaataacaagaaacctttgttgctttactgattgacaatgcttgctcagtgtttaggattttataaatagaaactaagaatttaatttttaaaaaatccactataaattcaagatagcctcaatctaaacagaaggagatcatatctgctgcctatttttttttttcttgagaaagcctgactttagagtcccatggagacagggtcaaaaggaaataatgaaaaaatccttgccttatctctagaaaattagttcctgaaattgcagtctttgcaggacaggtaggatttttacaggcctaataatttatgcaatccccttgcagggatagaaaatggctaaaataaaagccaagaactgagaagcaatttttattgtactatggttcaaatcttttcagggcaaagtaatttaaaaataatggaaaaaacacagtttgatctaagtgaccaaccacaaaacattgacatgaccaggtggtgacagaacttgcatgtttttagtctggtatagcgccggccagcgcttttacagataatccagtggtaaacctagtgcatccatctgggccacacacaagagatgctaaaggagggagagattgatgcgctggtagaatcaatgctgcactgacattcttctttcctttggttgtagtagtagcccaaggtccagacctatattgcttattgataaccaattctaaaaaaggctggaaaaaaatcagagagctccaagagagttaagacagagaaactcagacttcttgattcaagtgacagaaggcagcattagctcaaggtgggcctccctgaccggctggccacgttggaagggcaaaagtggttatggcaagtttaaagatatggccatcaaagtaatgtagatttaagctaaaaaacaatagctaagttaatttattgtacttagcatgaaattgagggacataaaaggaaatatgccaccatgaatgaaacatacatgttgatccagggaggagaataggtttccagaaacttggatcctaggcattatctgtagttgaatccctctagtgtgagatatggaatactcatcctgcagaattcactgttgcattatccagttagtttgggaaatgcagtatgttggatcccatttcttgaagatttgcttcagcctattaaaggctctgggaatgcctgcagtaaaggcatgtctcaaacttttttgaccatggaattccttactccctataccctcttcccttttctttccccaagaacataagggaagaaatagttctctggatctacttacttggaaaacactgctttgagggattttgttttctgtaaacatacactgggtaattttaaatatttataatttatttgagactctttggacctgtaatttcttctaaggacaattatattatctgttctaacaactcaagaaagggaaagctttagttgaagctggaaggctataatagatacttccttacctttgctatggcatggaggagatgcgtattttactgcctcattgatggggacaacttcttctagacctctcccccaaattttgaactattatcaacagaggtattttatgacaaacagttgttcaccaaaagtagagctgtcaataaatatgcatataaagtggctcctgatgtgaaattcaaaataactacatgatcggttaatagggtagagagaaagaaaagaatcaaaatagctatataaatgatagatcgggcagctgatacagggtcaaaaaagtgaaatgaagacaaaagggagactgaggtgggaggatcacttcagcctgggaggtagaggttacagtgagctgagattgtgccactgcactccaggataggtgacagaacaagaccctgcctcaaaataaataaataaataaataaataaataaataaataaataaaatttaaaaacaggagaaagaaaaaaaaaagtgacccatctaagaacttaaaatccctttattctgtgttcttttaggaccatcacttagcaggggctggatgatctgatgcataattgtaggggttttagggcccatacaattttatattttaaacaattttaacttaaaacttgagactttcatcttccatggaaaaatcaggctattggtaacactggcttgatattcctatgtggcaacagacaagaaactgaaggaaagcatcccactttggatgagcaagtgctccctgaatttccccaggtctaacctgatttgtaatagttctttaatttatccatgtggcctctgaaggcatttgagtttgtgttccctggttttggggcattctcatagcaaaggttctgctgccagctttctcttgaaactgtagcacttctccttttgaagaaattctaactgcttgatttatacatttgaattaagactttcataccgaaatgcaaaggttcctgacaagggaaataatctcagctgttgttattagtcattgactccatttattctcaagctggtgtagacagggaaagagagtggaaagaacatgagggcaccagagttctagaggaaatgtccagggaccaccactaaggagggagaaggggcaaaagaaactgagtgggaaaagtggtactctaattatgacttccactgccctattaactttctctagggctggcctttattattcatatgtgattcagatgtattggataaccggaagcaaaatgacagcaagatgaaatagggcagaccaggggaaatgccatgtggtggaaaacatgctgtgggaaacaatatttgtaaaagaatttatggctccatagagagtggtcagggcaagagaaatgccattctaaaaacagaagagcctgggatggcacttcctgtgcatagaagcgtcatgctttccttatagacacagacatggcaggaccagctggtaaataatttgtcccaaatgaaggtaccttccttctgatttcttccctaaacaatatgctgacgattttgaaatccttctcaaattgaatcaatttgcagttgtatcatcagacctgttgtaggttcagttgttaggaatttgtgctcaggaaaactagagtttattccagtgctggttaacattttgatgttttagtccattaaggtcatgttacttacgttacttaaatctgactcaacctatagagacacactgtgagagttgtggccagaatagataatgcctatgtaagtgtggaattaagctaaaaactctttctgttttcaaataaatgaataggattatgtgccccacagatggtatttcaatcccttgtgtgggatccattacaacagactatttcaacacaagctgttttgtttttttttttttctgtatgagtcaattactttgtagaggaaaagcttagtagaacatcacattgtcattttttagtattagcagttccccaaataaatatttattgggagggtctaaagccaataccttcataggcatttaaagagctctaccctccagtgatgacagactcttagttaaattgaatagtatgtacatagaggatttgagtgttagctcagatttttttttttctctatggagagagggctctttgcctttctgtaaaagttctcctcttactctagggtttttttttgttgtttaaacagcttcatggaggtaaaattgacatacaataagctgcacattttaaaaggtacaatttgataaatattgacatatgtacacaacccttaaaccctcacctcaattatgatagtgaacctatacatcacatacaaatgtttcctcatacccttttgtaatttctcctatccacccctccctgctcaggcaaccattgatcagctttctgtcactctagattgcttcgtattttctagagctttatataagtggactcatagagtattctcgcttttatatctgatttcttttactcatcataatcattttgagatttatgacattgccctatgcactgttagctcattcctttttattgctgagtaggattctattgtatagctataccacaatttatactttcatgtacttagcacatttggattttttccagtttttgacaattacacataaaacttctctgaaaacttatgtacacatctttgtatgggcatacatatgctttcatttctcttgggtaatacctggagttggatggctgaaccacttggtagttgatacagaagtgttcagagatactttatttgaaatagccaaaatctggaaatgtttggtattgctttgaatctatacaactattggaggagaatcgatatcttattaatagagtcatctgactcacaaacaagtgctgtctcactatttaagataatgtgtatattgtgctgttgttgggtaaagtgttctataaatgtcaaatagatcaaattgattgacagcttttttcaattcttctttactttctctcaacaatgttgtttgtttttagtgtacaggtccttcacatctttggcttgatttgtccttaagtatttcatattttttgaggttattgtaaatggctattcaatttctgattgttgctaatatatagaaatataattgaggttttgcgtagtgacttttatctgtaattttgttaagtgctctttttttagtagtttttttgtaaattccattagattttctaaatacatatatttacatagtctgtaaattaaggcagttttacttcttccttcctaatctatataagctttatttcttttccttgccttattacacttgctagaacccccagtatcatgctgaatagaaattgtaagagcaagaatccttgttctgttgttaatcttagaggaaagcatttcattcttttaccattgactatgttagtagtaggttttacatatttgccctttatcaggttgaggaaacgcccttctgtttctagtttgcagaaattttttgttaggaataaatacatttttctaaatgcttgctaaatgcaggcatcttttgaaataaccatatatgtgattattgtatcattcaggtctacttaggttatatatatgtatatgaaggaactatatatataggttatatatatatgtatgaaggaacatatatatgtgtgtatatatatgtgtgtgtatatatatatatatgttggaacaaacctcacatggtcataaagtttaatccttttacatattgttggatttaattcactaaaattttgtttagaatctttgcacctatgtgagtgatacttgtttgtagtttgtttctttcttactgcaaatgtctctggttttagtgttaaggtaattttggcctcacagttgggaagctgggaagtagtctctggccttcaattttctggaataagttttttttagaattggtattatttcctcttttaattcttggtataattcatcattgaaaccatctggaattggaggttttttaaaatgggaaagcttttaactataatttaattgctttaaaatatataggtccattcaggttatttatttctacttgaataagctttagcagtttcttcatttcatctaggttatcaaatttattggcataaagtttttattaacatttacctgtaaaaaaatctatagattttatggcgatatcacttctctcatttctaataccagtaatttgtgtcttctctctttttttcctggtaagtatagttagaagttgatccgttttgctgatcttctcaaagaactaggttttacttttgttgattttctcttttgcttttctgttttttattttattgatttcagctttgatttttattatttcttttactccccctttcactggggtttaatttgatctttgttttctagtttcttaaggtggaagctgagataatttcagagttttcttctttcataatgtaggcatttggtgctataaaatttcctctatgtgctgctttaagagcatttgacaattttgacatgttgtgattttgttttcatttactttaaaatactttctgattaatatatcttttgatttcttcattgactttgagttatttagaagtatgttattcagttccaaatatttagaaggattttccagatatcttgctgttactgatttctaactaaatttccttatggttagaaaactgctttgcatgcgttgaatcttttaaaattgattgagatttgttttatttcatagaatataacttgattattgttctgtatgttcttgaaaagcaaatatattctgctgttattgggtggagcgtactataaatattaattacatcaagttggtttttagtttcaaatctactatatcttttcttattttctttttaatagttctatcaattattaagactagttattcaaatctcctgctttaattgtatctatttctcattgcagtttttgaaactgttattagatgcataaatgtttaggattattatttcattataatgaattgaacatgttatcattataaagtgaccttcattatctctaataatagtctttgttctggaatcttcatttgatattaatatagctactccagctttcttttgattagcgttagtatggtttttttttttttttacatacctttacttaaaaaaaaattattattttttttttttgagacggagtcttgctctgtcacccagactggagttcagtggcgcgatctcggctcactgcaagctccgcctcccaggttcacgccattctcctgcctcccgagtagctgggactacaggcgcctgccaccacgcccggctaatttttttgtatttttagtagagatgaggtttcaccgtgtttgccaggatggtctccatctcctgacctcgtgatccgcccgcctcagcctcccaaagtgctgggattacaggcgtgacccaccgcacccggccaaatatttgcgtttttatcaagtgtgtttcttgtacttataagcagcatattgttaggtcttacatttttaatccaatctgttaatatctgtcttttaatttagatattagaccatttatggttaatatgattattgatgtagttagatttgatttcttcttgtcctgttttttgttctcatttttctcttttatacttttactttaagttgaatattttttataattctattttatcttcttcattggcttactagctataactgttagttgtattgtttttgtggttgttttggggtttatagtatccacatttaactgttctcacattgtaatttgaggcaaaatgatgcttcagggagagaatgaggtatgtatctaatggccagatttctaattcccctcatatcttttggtcatcccacttgcactaggtcgtgacacctttacttaaaatgtatggcagaagttctgagttcttgtatctcctccttatatagatgggtcttccatttttctgctagtatagatttttatttaatttagtaactgactcacctgaaagatcgttcaaaagagcagtgtattagttacaaatcatgttttactgcaataaatagagatttgaaaaatagaaacatatacataataaggatccttatgtcatgataagtctggaagtgggtggtttatggcacttatttatccatgcaaagaattcagagtgaagggttccatgattctcttggtccttccctcagagttgcctggtgctttttgcagattcagccatgtcttcacaccgggcagcaggaaggagaaagagaaggggagtcgcacttaccacctgaatctgtctcttgaaactgttttccacataggcatttcaatctagaaagagggacaataaatgtagtttattgctgacgtcactgctggccctggtacaagtaagattctgttaataaaggttgaaggttagacattgggtgtacaattggcaatgtctgccaaagatactgccagtaatagctctttgtacttgcccttaaatgacacgaaagccctataaggaatggagagaaaagacttatagatacaaagtttttgtattattattattacatttactaagtgcaaacatctaggttcctagcattctcaagctctttccaccactgatcagccatttatggacatcacacatgtggaccactggtggctgtggggtaagagcccttgaccccaagtaaaacgttatggaacttcagggatgggatgcaaggaaaaaagtgtgtgaagcagctgtttttgggcactcctccctgcaacattatttcaaagatatccactttttcagctcagatgttttatctttcatgagatccccttgatctcaccccagttggaattaactgcttccacagtccccacagtattgttataacagttttgttgagatgtaattcacataccatacaattcaaccatttaaagtgtacaattcaaccatttttagtatattcacaaagttgtacagccatcacataatcaagttttgaacattttcatcatctcaatacaacccctgtacctactacccatcaatccacgttaacccacagccctagacaaccaactaatatcctgtctatccatatggaattgtccatttggacatttcaaataaattgagtcattcaatatgctctcacagtatttttctgaaacctctcttattatccctggattctactctgcatttattgagtttgatggatctacatcagatttcctttacagactaagagttcccagtctgccatcttaatatacacagtagtgcctatcagtgtacctagtgcatcagtacatattaaactgaagaaaaagagaattccctttcctttttataagcaaacacaatagggtaggctgcaatataatgtttggaaatatgaaagcaaaacgattcctgtgcactttgtaattttgtaaggactttgcatgtaattgtcctcagataaaagtgtggggaagataaagtatatcttggaagtcaactctctgtttgcttctttctccttcctccttcgaatcttctgactcctgactcctggccatctagtacacctgccatggtatctgacccagaacaccctctatcatccttttcacccctactccctctcactcccattaaaatccatcttatgttttggtccactgggagtcagggaccagggtttaatcctatttctgtctttaataccaactatgaatattggggaaattacccattttcctgatctgttttcttgtctgaaaaatgtaggaatgatgctcagtaaaggcacctttaactctaaaactctatattcctctgtagcaactcactgaataaatgagagaaaataagatttgtgacttacactctttgctcatagcgtcagaataaaaggaacttctggtgacagataggttagctggaaggtttgtgtttctgttggataattgttcctttaaaaaactattttgattctgaaaacattttccatattaatttaaataaatatattctttaagacaatggtatatactctctttagagatataattgatttataaagaaggctttagtctttctactcctcctttcacttttttgccatccctaggtgaaaatccaaagggaattgtatgtggcagaagaaaaactattgagtatagttaatggctctcagtattaaagccaagtatttacaagtaaaaggaatgaggtccatgtcattggtaatgggatttaaatggatttaggaactgagactgaaacaggagcctaattagagaagattccagggtcatcatgtcagtgcccacctgtccatcaggcagacagactgtccacagctttcatttcaaagacatggcctgttcttctcatcagtgtctcttgcctcctagttcttgagggaaaagacgtcttggctgccctgtgcagcttgctgtgtctgaaggagcatactgagagtaggttgagattcagcttatatctggcctctaaaaaagatctggactcagaatatgatctttaatgattttcttaaagatcggtgcagaaaagaaatcatattggatagattatctttgcttgttattctagttttaattgcccttttaaaaaaagaagaaaggacatgggtagggaataaaatatctattcccattcatgggacaaccacacttataatgggtcctttgtacctattctttatatctctgctactgaacatctgctaagtggacctctgttcccttttttcttttctagttcattttggggttttctacatgaacaattaatgtctttagcctatattggtttttcatgtggagcatgttagttatagaagcagcacccagagtaggtggcatttgaagctgaataggggaggtaagaccaaggtagtaattgagctcagctaatctcttggtggtggtgtgggcgtctgtgtcatgaatgtgccatagtcagtgtttctgcaccttggtgagttgggacatcagagaataaagagagttctatagcttactctgccttcctctgttgcttccctttgctcttttccatctttgacgaggtttgttgctggatgtggagagcccagagatggtggaaaagggcatgcagcagagatggcacttgtataagcgagtctaatgtgtgaagattctccatcatggaagtaggattttgtgttctttccttttagactccatcccaacaatatttctcatcatttagatcattatttgcctttaggcatcaatgctcagaggtgattccattggctttagctttaattaagaaaaaagaaatcattagggaagcagattcccccttccaattcctaattaacttacaggcaaatttgttttctgctaatgacgcatccacattttgtttcagactttggccaaatgttagctcaaggttttcataaatgtaatccatattttaaaattaccatcacggatttttttaaaaaattattacaattgactgaacttcttggaattcatttcataaaacacaaagtttgcactatcaggaatcacgcatgagaacattgtgtgattatctagcaatctcaaagcattctgaagcaggtctcctttgattctgaacttagaaatttacttattatcttttttggagttaacaaaataaaagcaacaaaaaaccaatggattgggatccaaccatatgcaattctgattcttacttctctggaacatatgcttaacttgtcatgcatttatttacccaatctaataagttatcttgatattagagcagggtgctaggctggcttgctcaatcttacctttcttaccagttgattcaggtggaactcaattggtgtcatcctggagttaagagtcaacacaactacaattaaaaccaaagtttaatctccagcttctatggtgtatatcaaataagtagtgtgtggaagagaaagacgagtggtaaaaagtgaaaatgaagataaaaagtgaaaaaaatgaaaggatagagaagaaagggagagcagtgaattgagacctgtccatagaatactggaaatattctcccctcatagccagcttcttgctagatgaatacaaaactctaggttgctctgatggaatccagctttttgagtacccagaagttttcaaattctcaaatggtaatattaatccttttgtcaaataaaatcttacatagatgcccaagatataaaaacaatttaagtagtattaatataaatttaccatataaatgaacatttataacatttctttagtatgaagttaattggtgagaactacactattaaacacaaaagtctgaaattcaagaatatggagaatacttcctttcatcagccaccacattcaatttctgtgttttggtttaaatgcacggtgtcaaagaagtcttgtttcactttaaaggcaaagagtatctaatttttaaaacttctggaaatattcaaacagaattttagtagctttactatgttgaagaaggagaattggtaaacttgggtctgaaggctattcactgtaatagctgcaaacatagatgccatcagtacctaagacaagtgggaggcaaaaccctctcgtgttgacatatttacagttggtgccagagctctcactggtgggagagtctcctgtacccatgctgccatttaacacagtgtgagatagcatccagagcataccctgcactgttagacccaagcctactgtgacatttagttgaacttcccacactcaagtatggtagtttgctggctttaggtatgtacatatctaaattttaacaaaagaccagtaccttgtgcttacaaatgaatgacatctacaagttcaaacacatacctacaggtggaagcagacactgaaccctgaagttggcacatactgacttaacttggcagcaaaaatcaaaatagtgcagggccagtgtgttcatatgttacaggcaagttctgcttttaattgcaatgaaatatgtaattgtctgactcaaatattatgaggttgctaagcacttccttcaaactctagtaccagaaaactctaccctggaccagggtcccaaggtcaccagtcctggtattcctcactaaatcgcctaggtgctaaagagttgttctgatgatagcaagagagcttgtgttttccaaaatttatggccactttatttcattgtggtgtcctctccctgttggtttcttataacaaatgtatacttttcattaaactgttcctagcgaattctcacaataaagccccaacaccttaatttgtttttcagggtctctctctctaccttgcaaagctattgccccaaacactgcacccaacagaacttatttcatttgtttctctttttacctgttgcttttgctttctcttcacctaaaatgccctcccttatatatcttcatctctaaatcttatgatcaagaccttagaagtagtcatttttggttcagcaatatatgcactgtgagtgtgtgcacacgtgtgtatatacatatatacacacatattaaatatacaccttagtgcataaatcacatatattaatattaatgacatggaaatattactgccattatattaagtggaaaaagcacattgaaaaatatgattctatttttttgaggagaaaaatatgtaggaaaaaaatttctgaaggttctacatccacaaaaatgttaccagtttgagctactggagataaggcttattttactttttggtgttttatatatttgagcagtaagtcttttgtaataagacatacactaataaaatgcatctctaaagtacagagcacctcatcccacccttaaataaaattttagaatatccgaaccccaaaccctttaagtcgttctcacaattatgtatatatccagatattttaaagaatgtttaactgatgtgcatggtactaaggttgatgataatgatttggcacagcatattttaatgcctattttggaaatcatcagactgtccattcactcatgtttgcagtgatgccccttttgtctccaagggttgagtacacctaagatctttactaatgaaagaggattgagatttactgtttcccaaagacctgggtggcatttttcaaatattctcctcaacagaaaaagagcaagcaattctgctgtgtcatagttgtgaacaacgtgttcacaaagaagtgtgactattgtttctggtgaatgtattatgtaaaaaaaatcataatacataatcataatactccccatctactctgtcactctgaggccctgatatcttgctttgtgtttcgtttctctatataggcttcttctgaaacaaaaaggaatatttgatactcactgataatttttttaaagagtgaattaggcaattttccttgaaacttcttttctaatttagcatgaagtagaatagaatagtagaaatgatgggatttatttggtgataccaaaataagaaggggaattgtttggtcctacagcagactgtaagagggctgaggaacggactgaagaaaattatcaagcatgcatgttgtttttaagtgatacttgagacttggatgtgcaacagctgtgttgttggcttttttttcttgtgccaactttctttatttgattgattttctctctgacagcccactgtgctgataaatgtgtccatggtcgctgtattgctccaaacacctgtcagtgtgagcctggctggggagggaccaactgctccagtggtaagtttccacctgctgttgtctgtctcgggatgtttttgctgtaaggccctccttgtctgcagatgaccctgagccatgctttccctcttcatccctacacagagcatagtgtaaatgccacgaccaactcagtcatacagtttcttttaaatctgtacatgtacatatacattattcgttaattaagtataaagaaaagttcttggaaagaaggaaatttcagtgatcatacaacagctcatacttctgtggatatgaatgcattttctagagtagggtccacaatttagattccttacctcagtaaggcagttgtggtaacatagctattgtatcctaacttctgtttttacctgttgatttctctaagaaaatctcttggtgattaaaatttaccacctgttggtttttaactcagaagtgaaactggcatttttgacactaacatatctttttgtctctgaattctgagatgcaaataacgagtacttgttcagataactttagggagacttatctgtaataaaagaaaattcatgaaaattttggtacttgttaaatcaattcctaacatagtatataatttgtctccattatgttagaattataattctaaaatgatggtattttggactaaaagcagtctacacgtaacatttcatatgcattatcacaaagattatatcatggaatgtcatgtaatacagttgcttttctaaatttcacagtttaaaccaaaatcttctggctaacttgttgctgtacacgtaattgcatccacttccttttcctttatacttcttttttcgccttgagaaacgtgagaaggaattaaagtgcaactaaattgtaatgcgtgaaacattacattttgaaaaaggaagccatcgttttaaaaagttagcaagttcgcatgagagcacacatttctcttcgttgccaccaagtaattttttgaaattagtctgaatggacttatttcaataagctgattttaaaaatttttacttgcttattttggaattggggagattattctttatcttgctaggactacttgtttcggacttgtgatctcttggctctccttgaagcagcttctccaggggaagcccttgtgccgtctgtgcacagaacacttggtgtgaaagagccttttaactgtaccttaaacagggactgggactgtgtgtgtgtgtgtgtgtgtgtgtgtgtgtgtgtgtgtgtgtgtgtgtgtgtgtctttctgcccctgacaggcttctcaattccaggggaaaactgtcttgcagggttttgttttgcttctgttggaaatcaggaggagagtgggcattttgttcacacgccattgaggcaaaatgtttgggatgtgggatttggctcatgtccatttttctggccgactgacctcaaatgtgatgttgctttcattaacttttccagtttaaaaatcagttgtgcctagacatcttgaagaaaaataacattattataaactagtgggatagggaagagtgggcgtattagtcatttaaaactatgtggtttgccactaattccagggcaagaatgccacagaataacttcagttgtattcatactttgtctcctaagaattgcagactacctcgagctaagggctcagactgaagtgattgtgtaagcaaaacaaaagcctacatgggtttcagactctctagaactgattaggaccttctagaaaataaaccgttgctttattttggagtttaatgaagactctagaattctgagaacagatgttcttttaacactgaaatatgatattgaagcaacttttagtttattttttacaactcacgttttggctttatgatgaacaaaagcacaaataaacatgaacagatgtctgaaatgtttaaaggtgttctgagaaaaacatctttgatacctttttaagcaggtaaaaaaacgatattctgagctgaacccagaatataggtcttgctatctgggttttgtctgtggcaatcaacctaatgtcaggaaatgtatcattttgttcactcttgactagataattctggaaccaaaatctattgtctagtaatatgctacttagcaaaatttaaatggcctaatttctaaggattctatttccatctcccccctgctttggttattgttatgcatcaatttgatggtggacattagatccataatataattgctttgataattagactggctccttgtatcacttaagatccaattaggagatagaaaccacagtaatttttaaatttttaaaatacaaattggttttatttgggaacacttttagacttatagaaaagttgcaaagatagtacagagctcctgtgtgctcaaacccagtctcccccattgttaacttcttaaattactattagtttgtcaaaactgggaaactgaccatagtatattactattcaatcaactgcagatgttatttggattttatcaatttttccactaacgtcctctttctcttccggattccagctcaggccaacacactacatttcactgtcatgtctcccctgtcttctctggtctgtgacagtttctcagtctttccttgttttcatgaccttgaaattgatagtctagaggagaactggccaggtatcctgtagaatgttccccaatctgtgtttgtctggtgcttttctcatgatcagacatgggttatgagttttgaagagaataccagaattgaagtgctctttctcttcacatgatatcatgatatccatgtgacatcactggtgtcatcacttggttaaccttcatcacttggttaaggtagtgtgctaggcttctccacataaagttacaattttcccctttctgtactctactctgcagaagcaagtcactaagactatcgagccttcagggatgaagggcaggactcaagctccatgtctttgaggaaggaatatctgcctatattatttggaatttttctgtaaggaagatttgcttcttctcctgcatttattcaaacatttatttatatcagtaagaactcatgtatatttatttgacattttgggttataaaacagtattacataatttattttgttgcccaggtcattccagctttggccattgtgtcttttttttgttttgtttttagactagagtctcgctctgtcacctaggctggagtgcaatggctgatcttggctcactgcaacctctgcctcctgggttcaagcaattctcatgcttcagcctccctagtagctgggcttacaggcatgtgccaccacacctggctaatttttgtatttttagcagagacggggtttcaccatattgcccaggctggtcttgaagtcctgacctcagttgatccacccacctcggcctcccaaaatgctgggattacaggtgtgagccactgcgcccaacccattgtgtccctttgacatgactcatctttttgattttgagtgctttcttactttctggtgctagaagatattccaggctaatttttaatttttcctactgcagccctaaaatgaactatttttcaaagaagccttggtaccttttattgtagagtggtatttataaaccaagatctaggtgctggtgtggtcattgctactgcaacacagagtaactggaaaggagaaagtttaatataaagaatattaactaactataacaggagattggagtaatgagggatgggctagtaagaagtagatagatctctagagaatataggaatagcagatataagaagcaaccactacctctaaggtggacatagaatgtccaaaaaggaaaccccactaagggtgcgatccagacctgctggagagggcacagtcacagctcactcagatccagagaggtgctgtggtactatcctagcagaacttgctggaaatatgccctctaggacttttataggactttggaaaaaactcttcatggaaaagtctcaccagaagcactctgctacaaaaaaggggaagtcattggctgatgggtgcagctagccacagtgtactgcaggagcggtatgctagagaagctgtccgtgctgcaagagcttggttctggataagcaatttgtgctacagaaacaaggcattggaaaagccataggtgctccaggagccaggtactggagcagctattggcactgcgcttacattgcagaagcttggtgctttaggagccaagagcacaagtgcactacgtgctctgagtgcactggaagtagaatggaaaaactccttttgcaatgtctctctagcgccccctattgaaaatacttaacatttggccaaccagcaatagaaaaatatttggagggcacatacccatttttgtagagcaggcaatgaaggataaatttagagctgaaaggcaataaactgataactgttgacgcatactcctttggttatccaattcctatatgcaccctccacacatgtttgcattcctatacataaaaaaaacccctgtatttccacctaatatacagcaattcatcttagaagtgaacatgctcatactctcttcctaaaatgaggagatgcaagtcccaacattcattggattcattgctggttatattaaatttttttcaaattaagtcacagttctactgaatattctgtttcctagatactaaagttaacttgaaacaactagcatgtaaaacagaaaggaaaaaaagaaaatagcaaataaaataaacatatgcatataacaaacaaataacaaacattaagagctattaaaaatgtctttcatgtaattggtcacaaggtggtaactgatatctatggcttccctcttctacttcccatcccatatttcccccactctcagcccaaacttcagttacttggggttatttacctggtggagtggctcaaaccatcattactgaaagatctgcattcctacttgtcctgccttttttctggttgttgacatttgtcatcaacttcattactgtcatgggagtattaagaggtattccacagaatcctcgggttccagacctaggtgttccctccctgtgcagcagcaacccaattttcccttgataatctggatcaatcactccaaccagaagtttaactccttttactgacattaggagtctaaaatggtcagatggtaatcaattgataactgtcctacatagctgtcttttttttttcctttctaaaatacatgggtgattaagggactgacaaatactttcagtccaatttcaaaaggcttctctttgagatttgatatgtctgtttgccttggcagctgagggaagggttcctgcctgtgacaaacagtcagtgttcctggctttcctgggtctcaatgtattctctgtataaaaaaccaggtatgtcagagaattgtaaaaagtttgttctcccaaaatgaaatcatgatttatttgactaggcttagacatattccttctttttaaatttgattaaattattgtttttaaaaagcacacatgtgttttacctttattggcatcctaatgcgtatcctagcttttatgagtgaatgacattaatctattttatcccatctccttcttccctcccctcttccctgctctagctctgttcttccccccatcaatttatctgcccatgcatcaatcctccattgctcttctcccctcactggatgataaacaactcctggagggcaaaggccatatgttattaatctctgtaagcctccattgtgcctggcatgtggttggagcacagtaaaacttccatttaattagattgaaggaaccatatgattctatatgattctgagaaggtcattcatgtgttcattttgtgaactttcattgaatgattactgtgtgcaagggactgcattgaatgctggggataaaggaacaaatgagtaatggttgctgctctgacagagctcatagcttgggagaaaaataaagtgaaagaaagagaactgcctctgtagaagaagtagattgagggaaactggatggagtcagataaggtagtgagagattttctgagtggacaagggagacaagggctaagagtgtacagcccttcactttcagttggggacagaaaacagattgcaatagactactcttccagaaacttctctgagaagccaaggagaggaagcaaagaaatagagagttagtaagaagtaagtgtacggtcaagaaaaagttttttgttttcatgcctttgtctatgttttaaggtgaaaaaagactcagaagctgagaagatggtgaaagaaaagagggagaggctggagactgggttgagagagtggattgcggaatagaggcaacaaggcacctgagaagacagctggcagatgggatgggatcctgggcactgacagagagattagtaaggagtactgcccattcccaatagaatgaggaagaaaaccatggccagaataggtgtaaacaggtttctaggtatcaggggtgctggtgggcaatgggatggagaatctgaggaagtctatatcagatgaccttccttctcttgataaactgtcaggagagagagtctgctgatataaaagggggcagaagggcggttacattgatgatcatgatgatagtaatagttcacctttattgaacacttgatatgcaatcatcattataagagctttacaggaattactctcttaatggccataacatactataagatggttgcagttattgttcctagtttacagatgaggaaacggaggtgcagaacatttaggtgacttgcctgaatttatgtatctattaagtggtggagccaaacttgcatctcattcagagccagtaactttaatcaccgtggtatggggctaacggaagttggaaaacaggtttactgaaagtagcaagaatcagcaacagtgaggagaatgagagcaggagacaggggcagatgacaccggacgattatgaaaacaaaccctctgagagacgttgagggcccattaatactagagatgatgaattcataatggcacccatctagactttcctcattcataatcttgtgaatgttggggcagattctatttatgatccttttcaattctgtgattttatgtatgacttactttaagcaatatgtatatgcaactcctgagatctttctttgtgatggaaaccctttaaaccttttgtatgaatagcagtaacacatttgttttcttattccatataatcctatttataatttcccaaacatctatagagaaatctatttcacctacagctatagggcacaaatggtagagccctaaatcagccagcatatggttttcaaatgcttgtccctcgggctctttgcttttgacattagtaccacatagcggcaaaaatagaaattagctttggtctagaaactccaaacttgggttttattgagtcactaatagcattccggttaaatatacttggcagtagtgaaaatatccctaggaggcaagactagctcaaacattttcaggtgcagcgtaaggaacactgataaccttttgtgtaaagcaggcatgatgtacagcatggagaaagtaataagattttgcctgcaggatattcgaatggggggaatccatttgaaggatattatgagccagaaacataaggcacaaaaagctgacatatttcctagcaaagtctgctgtaaagatctattgactggcaacaatggtgggatcgatgctgtctgcggagagtagacgctgggagcccagtcctcgctgcagtcattaacaggcctgttgcgctgtcagaattactttcgaaatcaggttgatggagcagcaagaataagagtagatcagttgggttcactggtgttagggtcaggctgatgatgataactgggaaggattgggttctgaacagttcatcagaacggtcccaaaggtagtttcactgatggaccatccaaatagtttgataaaggtcacagacagaaactgctgattttgcctttcctaaggagtccaaaatttggactgttctttgccactttcaggaggggcaaagaactactaccaccaccctctgtcacccaccctggaatggaattgctatccccctaactgctctcctttctgtgatgtttctgtgcctccctttcctcatgctttgaacaaggataagaatatctattatactcataggcttgtggggattaaatgaagacttaacaggtattcgccagtgctgtgcatggcagtatataatgacaagtaaatgctacttatgattccttgtgtgacaaacatagcttacaccacacttcttcacacatggcccagtcttttgactgaacagaggatggggcagccctttgtgacatctcttcctgtctcacaggccacacccttctttatttacttatttatttttgagactgggtcttgctctgtcacacaggttgaagtgcagtggtgtgaccatagctcactgcagcctcgacctcctgggatcatgccatcttcccacctcagcctcccgagtagctgggacaacaggcacacaccaccaaacccagctaatttttttattttttgtagaggcagggtctccccatgtctcccatgcaggtccctactctggggctcaagagatcctcctgcctcagcctcccaaagtgttgggaattacaggcatgggccaccgtgccccgccccctacaccctgctttaaatggaggctctctttgtccacagttgcttgccacaagattccccagacagaagacctagtaaagttttattttgtttttgtttttggttttttttttttggtgcattatttccaacctctgatcacagatgtccttaccagatgaaatcatatccagtttatattgcttctggcatagtgagaatactaatgatgtttaaattacttgtgctagtgagttcatgcagtggctttaaagataagactgggctgtcatgttgtttaactccacttcatatcattcattgatttttcttttttttttttttttttgatacttggtgcaatattcatttttcagcaaatcttgttggttcaactccaaaatataacccaatccaacctcttctcattatctctactgctgccactccagtccatgccacgttctctctaaactggtgatcgcggtagtctctttgctggtttccctgcttcttcctcagatgccacccaagtcaattatctatgaccagagtgagactagcgtgatcttgtaaaaatgtactttagagcatgctgctctccttcccaaaactggctggaatttccccttacagttagaatacactccaaagccctgagcacaatccatctagccatgcatgatctattccttcctgtttccctgatgtcttctcattcttctacctttcaggatatcacactgctcagtctctgcccttcatttatggaacacactcgtcttatttttgcctttgcacttgatatttcctctgctcagaataatactcatctccctggttctttatatggccagcttctttttttttttttttttttttttgagacggagtctcactgtgttgcccaggctggagtgcagtggcacaatctcagcccactgcaacccgtgcctcccgggttcaagtgattcttgtctctcagcctcctgagtagctgggattacaggcgcccaccaccatgcctggctaatttttgtatttttagtagagatgggatttcaccatgttggccaggctggtctcaaactcctgacctcaagagatctgcccacctcagcttctttccaaagtgctgaaattacgagtgtgaggcaccacgcctggccacacggctggcttctgtaggtcagttagtcagcctaagtgccaccaccatacagacactatctctgacctccatatgcagagtatgaccctattactctgtatcatatctcctttttaacgtttttaaataggaactttctaaaaatacttgatttgttaacttgttttttttttttcttgtctgtcttcccctccaggatgtaagccccatgaaaacatgggtttttgtctgttttatccctgctgtctagctatcactgaatgtctagcacagtcctgggcactcagttatgcttaataaatatttgtggatggaaggaatgaaggcgtaaatgtgccaggagcagtgacagatataaaaatgagacatgagagatgagtaagacactgcctcttctttttaggggctcttagtttgatagaggagctgaagtatgtaaacaaacagattggcaaagcatccgaagcagccagggaggaagggaccaaaggttttcgacagagagggcgtgatgcgaagtccttccttcagtggcctaaggttgctcaggcttctgtggcttcaggacgcaccttggctatgtgcagtgtagacacattcttttttttctttccttttcttttttttttttgagatggagtctcgcattgtcacccgggctggagtgcagtggcgcaatcttggctcactgcaacccccgcctcctgggttcaaacgattctcctgcctcagcctctcaagtagctgggattacaggtgcctgtcaccacgtccagctaactttttatatttttagtagaggcatggtttcaccatgttggccagtctggtctcgaactcctgacctcatgattcgcccgcctcggcctcccaaagtgctgggattacaggtgtgagccaccgcgcccagctgacacattcattcttaatgacttggcagaagatcccctggccatagactggtagctgcaatgaaattatagaagtcaggcaagatgtactgggtgtgatttctgtgaactttgaggaaaatgtgtgtctcggagttcttcaccctcaagagagaaaaaattataatgtaaacatcaaggttattactgagagggaggagtgacttctgaaatggtggccccatgactaaggaaggtgtttgaaaatcagcccttgtttgagtggagaatatttaacaattttgctatctaaactttctcatattacttctcaaggtggaaattctatgtgaggatgtagaacttagttgttaaatttgtacccaaatggtgtacaaatgcatacaaactgcaaatgaacagtaagaaattaggcaaagaaatgcagactacaaattatttctaatcacatagtgatgagtcgaatttcattaatcttcttagactcctctttaattaaataaatagcaggaaataacagcccggtttaaaagaatgtttgtacagggagcagaaatattagatcataaatctttataatttctttcatataaacatatacatgaaacatatacaaaccattttctgactgtaccaatgtgtttgctggctgccgtgctcagagtgaagtgatgatatgtacgagatggtgctgtagacctgcttgtttccctctcctactgtcttgggctactgcccgattctaatagagccatgtgtgtcttgtctcaggggattatactgtccactgtccattggctgaaactaggtgttgtagtttattttattgtgttttgttgttgtttctttttgtttttgtttttgtttttctcgagacaagagtctcgctctgtcacccaggctggagtgcagtggcgtgatctcaactgactgcaacctccacctccttggttcaagtgattctcctgcctcagcctcctgagtagctgggactacaggagcccaccaccatgctcagctaatttttgtatttttagtagaggtggggtttcaccatgtgggccaggctggtctcaaactcctgacctcaaatgatccacccaccttggcctcccaaagtgttgggattacaggcgtgagccaccgcacccagcctgttctggtttatttttataattcggcgtctgtcatggctatatctgatatcttattttttgtgagtgtgttaaagaactttttaaaacacttgaaaatttccccaggtcagaatttccccccaaaagctaatgactctttttccttctttgatcaaagtatttttaaaattcatacacaacctagttaattttaatgagtttgaacatttgtgcctatagcctggagaaaattaagtgttcttgagatggataaaactcatgaagggcagaagtaaaaagacaataatatttgtcctagttatatagactattccagtagaacaaatagtagagtttataagaacatagctcttggtccataaataaatggtgtcatcttaaaattctgtgaaaaccaaatggttttactactcactatttttgcataaaactagtggaggtaggtagcttgtaaagaaagtctaaattttaatggaattgatttgaacttgatgttagtatataattggaaatttttgttcatacattaaagaaaagcagccattttaagaaaaaagaaacttatgtggtaaaatcagtattatataagcagatttatccatgccttaaattagcttttagaatatttagaccacatcagagtttaaaagatttttaagacagaagatactatatgcaaagttaaaggagaagtgagagattaggaaaatatttttgccacataagtaaacagacaaatgattatttataaaatatgtaaagaacccccacaaattaataagtaaaagaacctctgaactttaaaataggcaaagggtaggataaggtaattcagaggcgagaaacctgattgaccaatgaacatgacaatatgctaatctttgtaataacaggaaagtacataataaagaaacaagatgtcatttctcaccatcagattggcaatggttaagaagtctggcaatggttaaaaagttaagtgttgccaaggatgtgaaaggaagcttccacataccacttccatgaaggcaaattggcagagtaactttagagatcaatttgactatgtctagagtagaattttaatgtgtggaccatgtaacccagcaatttttatttctacttctttataatttgtttatatattttgtggaaacatgtattaggagatagattatttgcatctttttaacagtgaaaatttggaaacaactaaaaatatctgtgtatatgggaaaaggtaaattttttggaggctgttaatgtagtgaaatgttacatagcagtttatagtataataatgaactccgttactataaacttgtatatagcattccattatattagcagatttatcattattaatcagcttatagtcctagctaccaagcaggctgaggtgggggtattacttgagctgaggagttcaaggctgcagtgagctaggctcatgccactgcactccagcctcggagacagagtgagataaataaataaataaataaaaataaaaagtaaatctcaatatcataatattgggtgaaaacaaaagattcacagcaacatgaacattttatataaagctaatacatatataaaataattctatatcttatttctaaatacaccccccaacacacccacaaaccagaagaacatatattaaaactatcacagcatttacctttgggaaaagggtagggaaagagctgggaaccaggcacaaaggagtcagataggactttatctgccatgttttatttcttgaattcagtgaggaaacaaatgttatacaatgttcataaacagttaagtctctgctgtgggtacatgagcctttgttatagcattattcgtagtctctcatagtcccatcgtttaaatttttttctcaagaaaaccatattaaatctttcagaccaaacaattagcattaaggattctagttttcttactctgagattttagggaagtcattgaaagcctttatcctttatcctcatgtgtccagaaggaagataagcattttcacaacagtggtcctgaatattcatcctttaatattcatctcaattcctacttcctctgggaaaccttctctccccctcctttctctccactgcccaaaggtacatggacataggtcctctatgttcccagcaatgtgtgcaatcctgtctcgtaacacctagcacattcttttgtgataaatctcactgtgggccagtctcttccaatagataaggaaatcttagctatggtacatgtcttggtaaggagcaagtagtaagtgctcaataaatagaacttcgtagccagagaagatgcttaacaaatctttaatgaaagaataaatgatcaacagaataaaaatatgacaagactttttatagcaagacatcttataagggctcctgaggttgttattcttcttttcacatcagtgaatgaatgtaatcctcccaaattatgtaactttagcctacaagttatatccttgagattttcctgcaccgtgaatagggtcatcaatatgttgtcatagagacacatcaacatttgcacttcagcacaatagagaataaatattttacacccctttttctggttcataatttgagataagcttacactgaagttataaaatgacagttcatttaacaaacattttaaaagaagaataaaggttctctctcagtcactgaataaaattaatataaacagcactgggtggttgtccacggtgatcgttggcactctgtcagctctccagaggggtttttgacatgtgaaggacgtggggttttagtgctttcagagtatctggaaaatacatttttattgttcttcttcatggatggaaaagctttatgaagttgttttatttttaaagtgcttgatgttttgaatgaggatcttttcttctaccattaacaaagggaatgacacaccacagccttgttagcctgaagcgcaaggaatgaaatcccagggagataaaagaccctcagggaactgaggcttaagaagaaagggtgtatgtttcaggaagaaccatgtttttctatcctttgagacagtggaaaattattttggtctcctctaaaaggcactctgtagagatatcttcttgaaagtgacttatttgtactttgcccatgttttagactataaagtattaaattttcttctctattaatttatctcatagtcatggattttcctatgtttaaagtccatggagaacattatagccaaacctcatataaatatatattgtcaagtcagtatactgattttgatgcatcctaataaatacttgatatttataattttttttttttgaaacagagtctcactctgttgcctaggctggaatgcagtggtgtgatcttggctcaagtgattctcctgcctcagcctcctgagtgctgggattacaggtacgcaccaccatgcctggctaatttttgtatttttagtagagatggggtttcgccatgttggcgaggctggtctcatactcctgacctcaggtgatctgcccgacttggcctgccaaagtgctggaattacaggcatgagccactgtgccgggccgacatttataatattgaaggcatatgtagtgttagttattgcaaacagtaacaccagtggggttagttatgtattataagcggacatctctttccctatgataagcttgagttctaagatttgatatgttatcccactgtaagtatctggtagagatgtatcttaaagttcttgacccctatgtaattcaacaattagatcccaaggctattaaactaagactttaaaacaacaacaataacaacaacgtggctgtgtatggtggctcatgactataatccctgcactttgggaggcccaggcaggagcactgcttgaggccaggagttcaagaccagcctgggcatcgtagtgagaccttgtctctacaaaatatttttaaaaaatcatctgggcatggtagcatgttcttgtagttctagctactctagaggctgaggtgggaggatcgatcaagcccaggagttagaggttacagtgagctatgtttgtgccactgcactccagtctaggtagcacagtgagaacctgtctctaaaaacaaacaaacaaaacaaacaataaaaaacacctgacctgctcagttcacctagggtttgtttacacctagtacaggtacacagaactgggcatttctgttgctgtcatttagaatcagttcctttaataagcatcttacagttcaaaatgcatttcaaggttgtatctgttgtcttagttggtgaaccatgggcatagataaactgaagaaaaatcaaggcagtgagattatttggtgcctctcaatttggcaatgctgtccagattttatttatgacatctttttatactgaagtggggattgctaagaaagtcatgtttttgtttatttctcctttcatatttccggaccccatatacaagcctacacttctggacatacagtcaccagcaagtaggaaatgtctaaactccagtttttaattggcaatgaaaaagactaaatgtaaagtagttctgggtttccttgcaggcctgaactcactccagttgtctttgtaaaaatgaataaaaggtccaagccttgtttttttcttgatagagttactgggcaatttcgtttttgaaattttacattgtgagaactaagttgtcctttctggcatgaatgattcatgcaagacaaacaaataatacaaaccaaggtcagacacgttagtgcagcttcatacacagttggaggatgtttttctagggcattctttttgctgggctgggacatcccaatgtgcaaatcagggaatttctgctgttactagatctgtgcagtgtcacatataacaaaaagtactttttgtgtaattagtgtgttccaccatcttcattttacaacaaataaaggttggggactaccccaaggttctgtagcgatgaattggccatgggctagctagggcccaggtctaggcaatgtaaagaggctacagtccctccttgagccagctagtgattgaggaattttgtaacaaggtgaacatgatggtaaacatcacttctttcttaaagggcaaaatgagttcatctatttttatcaattgcttggttggttgctgatagagtcctttggatgagacaatgtattaatgtacccttattccttcctccagagcacctctccatttaacatttctgtttatctctaatcgtgccccctttcttgtcctttgtctacctgaaaacaagagatttactagattctctccatgtgttcaaagactttttctaatgccttgtttttttgtcaatacctgtgtgattatggacatgataggatattccttatcaaaactattctgatgaacctgctgctacatcttgaagcctgggaactgtcattttaagcaaacaactattatttctcagataaacagttgtgagacatttgttctagaatgttcccctttgaaaaccaggcagaagcagttaatctgcactgattccggttttgtaattgatgaccatcacttctttggggtgttcagcgtggcataagggatgattgcagctttggagacattgcattgatggatttgggttgaacccttgcttttgccactcaaacgccaagtggctttgagcaaattgccatttgagttcattttgcaaatggaaatattggaataattatatctaactcattgagttattgtgaggtttaaataaaatagctgcataatgtccctcataatgtaataatgcctggcacatgttagaaactcaatgtatcttagaaagcctcccgctccactctctgtttcgtgtcgtttgcatggaaaattaggctgagggtttgaggcaggttaggagagaagaatgtacctagaattttgatgatgattttctgggtttctctgcttgtgaaagttatagcgctctacactcacaatcactctcatttattcaccagatattttctgaatgccagccatgtgccaggtactacatgggcctaattttcagatccatatactcttaaagctaatgacattgatactatgttcatagcaagctttctagcttttttgtttgtatagtattatcattattatcattttgaggcaggatctcactctgtcacccaggctggagagcagtggcaccatctcagttcactgcagcctcgacctcctggactcaagcaatccttcctcctcagcctcctgagtagctgggactacaggtgcatgccaccacattcagctcacttttgcatcttttatagagatgggatttcgccatgttacccaggctggtctctaactcttgagctcaagcaatccacccacctcagcctcccaaagtgctggaattacaagcgtaagccaccatgcccagcctacatagaattattatcaacttctagaagctcttcaaatctggctagctccttaattttcttttttctttttatttatttatttatttatttatttatttatttatttattttttgaggcagagtctggctctgtcgcccaggctggagtgcagtggcgcgatctcagctcactgcaaactccgcctcctgggttcacaccattctcctgcctcagcctcccaagtagctgggactacaggcacccgccaccatgcccggctaattttttgtatttttagtagagacagagtttcaccgtgttagccaggatggtctcgatctcctgacctcgtgatccacccgcctcagcctcccaaagtgctgggattgcaggcatgagccactgcccctggccaattttattttttctttgagaaatgtcttatgttctcactactgaggtaatttctttctcagtgtccctaaatactgagtaattggctgacccccaaagccttactcagtgaatcattaatcatttgttgctctgccttagaaagagtgctggtttcatattagatgagaaatataatggtggaatattatacttaaccgaaacatatcatttcagcacttcaggagcagaatggcctcatgtaaagcccttgaccttttgtatgcagaaagccttgggtttgagtactgatgccaccactgactagttttgggacattttacctaaatgttctaatcctaaatatcctctatgtgcttgtcataattgtcatgaggactagaaatagctgtaatccagtcagaatggttactattaaaaagtcaaaaaataacagatgctggcgaggttgttgggaaaagggaataccctgttggttggagtgtaaattagttcaattattgtgaaaacagtgtggtgattcctcaaagagctgaaagcagaactaccattcaacccaagaatcccattattgggtatatatccagaggaatataaattgttccaacataaagatacatgcaggtcaatgttcattgcagccctgttcacaatagcaaagacatggaatcaacctaaatggccatcaatggcagattggataaagaaaaggtgctacaaatacaccatggaatactgtgcagccatataagagaatgagatcatgttctttgcagggacatggatggagctggaggccattatccttagcatactaatgcaggaacagaaaacaaaatactgcatgttctcatttataagtgggagctaaataccgagaacacatggacacataaagaggaacaacagacactgtggcctattggcaagtggagggtgggaggagggagaggatcagaaaaaaataactattaggtactaggcttagtacttgggtgatgaaataatctgtatgacaaacccccatgacatgagtttaccttcataacaaacccgcacatatacttcctttttaaaaaggaagagatatgtaaagcataaagcactgaacctggcatgatgtaaatgcccagcagatagaaccatttaaaaaaccttactgcttgattttcttttactgccaaaaggatacatatttactgtaaaacatttagaaaacctggttaaaccaaatgaataaaagaataatcatgcataatctcaagacccagagatacccactgatgccatttcactgtagctctgtctctctttctcattttaacccttttccctcttttccccagatagtagtttcaaccatatgcagttgctgcatccttacctaaattaatggcagtttcatcaggttcattctgatatattgctaaaattggattacatggggcatcttttttttttttgagacagaatcccactctgtcatccaggttggagttcagtagagcaatcacgactcactgcagcctcaacctcctgggctcaagtgatcctgccaccttagcctcctgagtagctgagactaccagtgcaagccagcacgctgggctaatttttgtatatttttgtagagataggggcttgctgtgttttccaggctggtctctaactcctgacctcaaatgatactcttgtctcagcttcacagagtgctgggatcacaggcataagccactgtgcctggcctttttaaaatctactttttataattatgatatcataaatatggttccagttcataaaatcatcttctataaaaatcatttaattaatcgatagtattccattgtatgactgtaccacaattttttcaccagctgcctattcctggaaaactaggttgttttcaatttattgttataatcagtgctaggataaatgtccttatagctttggagagagtgaaatatagtggtttagaacacggactctggaggcaggaggtctgtgcttcaccccttgctacctgcgtaactttgagcaagtcacctggatctcaatttcttcatctacataatagggacaacaatagcacctgtttcatagggtcactatgagagttaatctatcacgatgcttggaacagtgtctgtgggcatgctaaggtattattaatgagttagctatttatcttttatgaacggttattgtctttatgtgtatatatacatacatacacacatgcgcgcgcgcgcgcgcacacacacacacacacacacacacacacacacacacacacacacacacacatacatgcttatttctttaggaaaaactcccaagagaagaatttatggtaaaggggctttattagactttgccagactaatttctaataaggatgtggtaatttactgtcctgtagtactatataagagtgctggtttctagctgggtgcagcagctcattcctgtaataccagcactttgggatgccaaggtgcgcagatagcttgagctcaggagttcaagaccagcctgggcaacatgatgaaacctcatctctaccaaaaatacaaaaaattagccagtcatggcagcatgcatctatagtcccggctactcaggtgggaggatcacttgagcccagggaaggttaaggctgcagagagtcaagatcgcaccactgcactccagcctgggtgacagagtgagaccctgtctaaaataaaaaaaaaaaaaaagagagtgctggtttccacacaaagggagaggctaccattatcactgtaagtatcagtctcaacattattattattattattatgactcagggtgcacagattttcacctctgaaatcagaatgcatctaatcatcatcgtcaaacagatgactgtcattcatgattgtacaaaaccttctattgactctgctgaaatgaagaaagagtgtcattgcatcctaacatctatgaaattccatttcatttggaaattacagaacaaggcaagcaaatataaagattatgaactagttgctgggcacagtggctcacacctgtaatcctagaactttgggaggccaaggctggaggatctgttgaggcctggagttcaagatcagcctgggcaacatcgtgagaccccatctctacaaaaagtaaaataaagaaaaattatcatctgagttcaaagtgaatgccatggaaaatagataatgccattttcagagagcatcttagatcggttctcaaaagtgtgcctaaggacagagtttcctgagctgcatttcgaaggctggggagtactgagggagcaagaggacaggtctactatctctccatagttatttctacttctttttgttgtgtacagagctgtgaaaatgataatggccatagtacaatagcagagagaatcaagttcgtgttgataaacttttggctgttgcatgtatcattccctgcagcccctgcacccctcacacccagacttcctacttaacagtcctctaccctgtacctaaatgtggcacaccctgccttttggtctcagtttaggcatcagtttagctgggaagccttttctgatgcaccaacactggttggttaagtaccatctccttatgttttccgttgtacctaagccatcccctgaccttattacttattattcagtattgtattgcttcagacttggtgtctctgtcattaaatggaaagccgctagaagcctgtgctctttattttcctttgaattccagtctagcaccatgtctgatacatgacaggtacttaaaaaatatcacttgaatgaacttcagtacccagcccgtgaatgtaacctggggttactggggtattggaagttataaccgtaagggttccaatgtgagtctattgtcttgagaagatccagttctctactagttttcacttacggactggagcttggattatatgtaatccaagtagtacccagcagtttaaacttccaacttattatgagagcttattagagcaagctgtctgtgcctgtctgagactctcattaagccattccatgaaatatctgcatgaatctgggcatcttgcatctgagagcccatttccggcggttagtgcagttagaactgaaaccagaggctgaaaatgagtcggcacttgctcactagcatttaggtcactttcaatttaatctgaaataaaattctgttcctttacttcttttttaaaaattaggatactcaagctattttcatgttaactatatattttctaagttgttagtgggaatagccaaccagtcactttctcttgtggagtgaaagaaactcttgccctgtgagattagagtgaggtgttaaggaaaagatgtcagatagtttgaattcagaccttctccgagctgtctctccaaatgtggtacttgaattcaggataactggtcaaattctgcactaaacataaggaatgaattctgcctccagtctagacaaagtcagtgtacccttgtagttatcagggatgagagctggcttatatgctgtagactgtgtaactcactgggatacatttaaaaatggatgcattgaagtggttaaatatgacaaatgaagaaaggaaaggaagtcacggtaatgtctgaattcaacccaggtttctgtgtcctacttgttcttatacctatttgtctgtaaacatgtggatttttttcctgaatagaccatgttgatgtatggtattcacattgtgaggtccatgtattagtggcattttaggaaaatatagcccgaagtggggaagctatcacttgaaaacatgtcatcatgcttggacatagccaggaaattaaccatgtcagcatgataatatttcttgaaaagcctgaaacccatttttctatgctgatagttatcagtttctgctataaactcacttgtattatgataagatatcttcaaagtttttttttttcttttttttttgttctaatcctaagaaaacagagctggtgtctgcctgactgccccactgggagataagttgttgaatgaggtgtagaacagggttgtgaagaagaggaaaaatcagttctgtcccctcagttcctctacttctccctacctctctcttgttatataaaacatgttctgtaaagtgtatgtgcttggggccaccctgaccacagtgtcacatgggggaaaattctgtaataacccaccgtgatttttaaaagtgttttgacatgatcttgttgtttttatcaaagtaatttttattaggtaaaatttcttttttgttggtcaactaattctctactgaacataaggagttgacagatatttaattcaatatctgaggttcctagaagttaagagggacatggaaactttggagagcattcagtaaaaggataaatgaaattgaataaactttttgaaagtatggaaaagtattggagttgtagtatctagagaagagcaggccaagctgcattcacatttgggaataaggtcatttttaatacagaggagagtggtgaactggtttactatattgtgaaaaagtcaggagaaaaaaaggattcaatgataagataatggatttagctcatacggaatgatttttcttactcttgaggattgatgaatcaagtaacaagttacaaaggcctgtgtaatttgttttggagtcccttcaaaacaggatggagtcttctctacctggggtagctgagatcaaaagggacatatcatgtaattttcttaaagatttttttcttttgagatcctagattaaaagaattacagtggaaaaaagactcattgtccatatccataggcaataaaagaaacaactcatatgaataacaattaggcttcagtctcattttgaaactaccacctaatcttattttgtgaaagaagattgtgagttcttaggtaattgctttcttgatctgctttaggttcaataattctctctcattgtttttaattgtattaaagtgtgtttattaaaatactaatgagaccaaagtcatactgattaaaaacagaattattcatttaaaccttttgatattatgaaatccaaggtagagtctaatattggaagacgaattcagtacttctgatgagttgtttgctgtgtacctagagttttcttcttttgaacaatttattccagatctgttgaagttacaaaatttttatgaaatgaaacttttttttaattgtaaaagcagtttattttgagctctaggcagggtgcttcttcttcaagtgatttttatagcatctaataaatataccgctggctcagcaatacatactaagagtagattttgtttatcatcaccctctttaattttttagaatgtttggaattgaagtttttttccttccctgctccccttttctactcactgacttttgtattgcagccgctctttcttttctttggaactgcactttaaatatatctctcaaatgccattttcttcctttgtcttttacctggtttcgtttgcctattatcttttcatttaatttggattcttcggcttcaggcttgtcttattttttaaatatgtcaatatatttaagcatatttgtccattttttctgcccttttttttggtcagtaattcagattaccttccaaacacagatgttttgactgatatcttttttttttttttttttttttttttgagacggagtcttgctctgtcccccaggctggagtgcagtggcgcagtcttagctcactgccagctccgcctcccgggttcacgccattctcctgcctcagcctcccgagtagctgggactacaggcgcccgccaccatgccctgctaattttttgtatttttagtagagatggggtttcaccgtgttagccaggatggtcttgatttcctgacctcgtgatcctcccgtctcggcctcccaaagtgctgggattacaggcgtgagccaccgttgactgatatcttaaaagcagatcagtagtttacttcttagaggactcaggactctggcccagacctgtagcagggtcagtccactccccagtacttctgactctgtgtcccctctcccttttcatggttactgcctgtgatggtcatctggactgttgccatttttcctgctccatctctctgcctctcatcgtcagctccttccacacacgtaggaggaggcaaatctgtgctctcccttcttaaaatctttcactaccaatcccttgttcacaagatgcaatccaaaccccttaatatgctaaaaagtccctgcatgagctgatcattcccgtctgcctagccaggctgctctccttgcagaacccctgagctcttcccctagcccacttctctagccacatcaaactccacactctggatgcagaacacagtctgagtaaaggcatggagactttttatttatttattgacatgattgtcaatgaagtgataattaagcaatggagtgacaggaggtggcccagttggtgctgagcaccagtttgtgaagcattgccatgggttggggccagggccctgatgtccagctaatgaatggccatgagaggtcaccaagccattctccccgagaggcgaagaaatctggttctcccttacccactgatatccactgtttctctcctcaatctcagcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttgtaagtcacatgctgcccagcagcagagcagagcccacccaccctctccattcatgctgctgctgccatcatatttcttgtgcctcagtttgcattgctgcctgaagagttactgatgggtctaggctgcaggcacagttatagaggtcagcagtgatggccactaggtgctgctgctgtttggcccttgcacatcagatcccagcctgaatctaagggtcagcttccatgctttccttctagcaggcaaagagagagagggtcagtcaggatgttgtgttgaatggcactatttgggggttgttggggcatatttgggattctgtttggatctcccgagaatatgttcatttatactgctggttgttaatggtccatgtctttttgctctttgtggcaattaattagctggggaaagctgggtgggttcagtgcattagaagagaaaaggaggaaggtgttaaaaataatccataataaaagattaactcttagggatacatacattatttaatgctcatggatacatattgctttgtgaatgtgaagatatatgtattacatctatgtagattttgtgcacacacatagtttaattctttctgaggaacattcaagcaactacttaacctccactgtctttattttgttggaagggcattcttcagttcacttctattcaccaacagaattaagaggcagaagttgctaaaaaaaagtaagagatagaaaaatcctcttcccttactgagaaaattacatttataaatcaaagaactaaaacttgaaaaaacaaaatgtggctgattaggtaaacacttcctgccaacagtgttaaacgcctgtagagtggagctaaagaaaaaaattgcattagcctagaaagccctgattttcagaattgatgattatctcaaactgtttaattgttaatattgcttttatgggttttcatcaagaccacaattgaactgggctgtgggaaacttggagcaatttcccaggagagcaggaaagacaaaggcttaaagaagaagggccatgcgacacgtgggtgggtgagggaagggaaacttgtcagtcagtaggagagaacaccaaaaatggatgatgagaaggagttcatgtcctttgcagggacatggatgaaactggaagccatcattctcagcaaactaacacaggaacagaaaaccaaacaccgcatgttctcactcataagtgggagttgaacaatgagaacacatggacacagggaggggagcatcacacactggggtctgtctgggggtggggggaaaggggagggagagcattaggacaaatacctaatgcatgcggggcttaaaacctagatgacaggttgataggtgcagcaaaccgccatggcacatgtacacctatgtaacaaacctgcatattctgcacatgtatcctggaacttaaagtaaaattttaaaaattaaaaaaaaaaggatgatgaatatgtgcacaaagggtgtgatgtgcaacatctcaattttctttgggaacagaacaaacatataaacaaaagtagacttaaactggagcacaagcgctttataagtgttacatgagaagttcctgtcatcaatgagtgtttggccagttttcttcctcagtgttctcagataggatagcttctcttcaaaccgaaatggctttattagaaagtaccccaaaacaaagggaaggactgggtgactcctcaaagacacttccaggcaatatgattaatgttcttgatgttaattaattaaatgaacaattattgaacacagaaagcttgtctattttggggaccctgggtacagtgaacccgagggtcatgtgtctgggaaataacagtgtcctttgtcacatgttaatccctcagctgtgaggatctttgtcctcctggtaaacatggtccacagtgtgagcagagatgcccttgtcaaaatggaggagtgtgtcatcacgtcactggagaatgctcttgcccttctggctggatggtaagcttccttcccacctcctctgcccctgccccaaagtcacccattccaggatactcagtgcatacacatgcaggagactttagcacaaaggaaagttaccatgatggttgaagattccaaaattggaaagactcaagccattttaaatctgaaactcttcagttctgaggagacagaagaaggtgatttagtcctagacttgaagtgcattgaaggttgtcatgtaaagggtagtggccatctgtcctgcatttcccttaaggataaaaaaaagagagacaaatatctagtctcacatgacagtcagtgctgataaacactggatttatttaacaatcattttcataattttgttccatgagttgctgttgttctttgggaacattattcttaacagtgcaagtgtcacctgaaaaaaaatcatagaaatctggggatacattgaggtaaaccacatttaccaagtattgcaggacttctcagagccttgagtgtgataatccaagaggaagctattcaacatgttttccaaattttgacgagaataccctttcttcatgtagcaatttcacatgcttagagttatgtagaatacacagtgacaattagcttcaaattagacatctgaaatcaggaaatataataatattgatgtcatctctctgagttggtttgtgcctgtgtctgcttgaaggcagatgagtgagcaaccaatatctgtttccttcattaacaaactatttaacagagcaattgacttttttatcaccttctatttccatgagcagtgctaaagctgttctttcagaggttacaagggacttaattaccaaaacccttctgttctcattcagcttcatttctccaaagcttttcactctgttgagtaccaacctcccttccttaatccctttgccttctatttttctaatcatcccgtctcttacctttcatactaaagatcctttttctaatctcccttcttctgcatacttcttcattacaggattttgtaggtttaagtcttgttcttctcttttctcaccataaatccactctggcaatctcatccagacccatagctttaagaagtacttgatggtttttccagattttgatcttacctgccttgagcttagatttatatttgtcaccccaaccttgataacctatagacacaaagccaccgtctctttgggcaatgcccaagctagagtctccacagccagacctggtagtagaattggtctggtattgccttttcttgtggctatggaacaaaggagacctggagtccacttttccatgagggtcttgggaagtaagaacagtttaagatgtcaaggccactgggacaagtatacaataaaaatcagatctgagagggttagaaatggtgagtagcccagacaaagttcattctggagccaaagcatggagaaacagcatgaggcaatggagttagagagagaggagaactttgagtgcctgaggatgaagacaaggtgaaaaagaagctgtttaaggagtactgagcaggtttgagtaggcctggcagagtcaatgataataaatttaataaatccaaacttgtacacccaagcctttagtaaggctactccttctctaccttttttgtcttggttaaaactaacacttctctcttagttgtctgaggtaaagaagctgggttatttctgactcctcctgttctttcatttcctatactcagccttttgccagtgttggtcttttgcaatgaaagtattttgctggagcagcagagtgttgagaactccatgctctttggataaggatcttcaggccttttactcctaggacttctgtgtagatattgtctgtggagttgccttgccttgaggctgaagctcttctcagttgggatggtcaggatgtgggttaatggtaaccacaggcttgggttatgagtcccagcacgtggacagatggacccctccctagcagcctaagggagcctcctctcacctctttatctgtgtcccaggccccttaccttacttctgcttcaaaaatgcttcagtttgtttttttctcctgtgtagctgagctttcaatttatacttcttctttacaacatgttatttgtgctgtcatcctaggtgcttttcaaagatgaatatatattcctatagacacacataccttcatattgaaacgaagagaaatcatgtcctctttaaagctgcttgtgaatgttaatctttatgcacgaaaatatttcagcgcatttctgaagcttatgtgggaccattgtgggtagttaagtcaggccctgggagagtgagaattttcaccccttcttaccacagactgaccttcagtatgttattcctacagtcatgcttttacctcacattaagtataccatgtcaggctagaatggagagactagagcgatttttacatccattcccctccccacattgtgagctaattgagggttgttaccttatctttgattctcagtgcttagctcaacacaggcacatagatgattctcagttaagtgctgattcgaatcatctctcaaaggccttttccattccaagagtctgtggaagaaatttccctgtttgtagatagctagaaaccaccagaggagacttaattagcacaccaactgcctttgtgggtagccaggagttagaggaagtgtattttcttatgctgtccagaataaacatttaggaaaccatctggtgttcactagcctccaatttcagagtgcccacagtctgcctttttttagagagagggaggacagagcaacagcttccaatagttaaaaacattagaaaaatccctgttatttgggatatgttgtttgtctaattataactccaataaatagatgagaagctatgagcccaagtgatacagccaagtgaagaagaaaacaagagtatttcattgacttattggtacagtatcttattcctatccacgcaagattggagtaaatataatgactgtgcttgacaagatggacagcctctagggtgaggagaaatatccacgttactctcttggtttttctccccaggaaataagttttcctattgatcttggctcagcaatgcttgttgaatctgctgaaaataaaatgtttttcttctgaaataaatgtctaggttcgttcctgtagaagtctgtcttcggcaatgtgattgttaattcaggtacacaaaatttcaatcttgtgttatgctacattttaagaaataaagccaatgataaaacatgtattttctctagaacacatggtaaagcatttggatattccatgtgcggcagatgttgccatttatgtaacggatgctcaataagtattgttgacttattgtgcatgtaagacacaaggaagaacacttatgaggatttatacattccttaggttgccataataatttgatgtaactttgttttaaacttcagtttttaatatggattttgcttaacattactattcagccgtctttgaatgtatcttgagatttgggcttactgagtaattaagtcaatttaatgtttctaatattttaaagatgatgaacagtttatgtgctctaaaattctctaatctaattttcttgcagccctgttccccatccctcctttctatttcctctcttttcttcttcatccatcagttgtctttccctggctggaggcccatctaattttccaagtctctttgaatgcagggcacagtgtgtggtcagccttgccccgagggtcgctttggaaagaactgttcccaagaatgccagtgccataatggagggacgtgtgatgctgccacaggccaatgtcattgcagtccaggatacacaggggaacggtaagggatgcccttgtatttctctgactgtttataatgatgtgaaaggaaagtttgtagggtccggggagcatcttcaataccatgtgtccatgactcttccataatatttcagaagtagctatacagcctcaatgtgtttgacagattctatcttaattcagtgtatagaaactgaattataaatagcaatggtaaattgaagataacagaaaaagcactaaaaaaaagaccataaaatatcagctattcagaacccatgatgaaaatgtcattctagagagttgagtgtttagtactgccacttacattgtaagtacttggtgatagatttatttttaaatgggatgtgtacttaggtacctttcaaaagtataaagttactttcttatgattcagtattctgttaagaatattgatcattatattgtgtggtggcgatagagtcagatctgctggaacttatagggccctctggtcccacacgaaacagaaaaaatggctgtgctcatgcgggtcttactgccgctgtttatcatcctctgtatttaatggtaaactgttatctcagagcgctttgcacaccctacttctttttctttaatttttttatttttattttttttgtgggcacatagtagttgtatatatttatggggtacatgagatgttttgatacaggcttgcaatgtgaactaagcacattatgcggaatggggtatccatcccctcaagtatttatcctttgagttacaagcaattcaattacactcttcaaattatttcagaaagtacaatgaagttactattgaccatagtcaccctatatgctatcaaatagtaggtcttagtcattctttctaattttttttgtacccattaaccatccccatttcctccacaccctcccactatccttcccagcctctggtaaccattcttctactctctgtgtccatgagttcaattgttttgatttttagatcccacaaataagtgagaacatgtgatgtttgtctttctgtgcctagcttatttcatttaacataatgatctccagttctatccatgttgttgcaaattactggatctcattctttttatggctgaatagtactccattgtgtatatgtaccacattttctttatcctttcgtctgttgatagacacgtaggttgcttccaaatcttagctattgtaaacagtgctgcaacaaacataggagtgcagatatcacttccatatactgatttactttctttgggtatatacccagcagtgggattgctggatcataaggtagctcaatttttagttttttgaggaacctccaaactgttctccatagtggttgtactaatttacattcccactcacagtgtacaagggttccgttttctctgcatcctcaccagcatttgctgttgcctgtcttttggatataagccatttttaactggcttgagattatatctcattgcatatataaatgcaaatcattgtagttttgatttgcatttctctgatgatcaattgtgttgagcaccttttcatatgcctgtttgccatttgtatgtcttctttcaagaaatgtctattcaaatcttttgcctatttttgattggaatattagactttttcctatagaattgtttgagctccttatatatgctggtcattaggttggtgcaaaagtaattgcggtttttaccattgaaagtaacggtgaagaccgcaattacttttacaccaacctataaccccttgtcagatggatagtttggaaatactttatctcattctgtgggctggctcttcactttgttgattgtattctttgctctacagaaaatttttaacatgatgtgtgcatccttcttttaatgctcttgaatctgtcatgtcctggaagactaggtagccaggctcactggatgtgtgtgtaggatttgagaagagacttgagaggcagaaggtcatagtgattgaaaacaattatttggaatctaggtttaggtaaatgtgtccctggaaacacttttttttttttgagatggagtcttgttttgtcccccaggctggagtgcagtggcatgatctcggctcaccacaacttccatctcccaggttcaagcaattcttctgcctcagcctccctagtagttgggattacaggcgcatgctgccatatcaggctaattttttgtattttagtagagatggggtttcactgtgttgcccaggttggtatcgaactcctgagctcaggcaatctgcctgcctcagcctcccaaagtgctaagattacaggcgttggaaacacctttgtctgtaacatcctaataataattgtgcttctctctagggttgtaaggattaaataagttagtgtgttaaaacatttaaaacagccctggaacttatcagattttattattctagagcaatttctatgaactatgtaaatactagtgattatcagtttgagtgctgtttacaagctgcataaatattagctatcattattttttatgatgtctttgaattaagaattccctcaacttttttccccttattttttctctttctaaatcttggtctaattttatgacttttaataagatactgtcatgtttgttgcctcctgcctccaacttagaccctgtactttcttattaaatttatttctgagtattttgtaattttttaaaatttcatttctgcctgtaattggatatttctggttgaagaaaaacttgcttttgactatttactttttaatttattcatactaccaaactttcaaggtaattttaatgttgtttttagcaaactctggagttatttagttatactatcatatcatctacaaataaacataagttagtcttttcttttcaatatgtataatgattatttcatttccttgaattattgcataaatttgagcctccaaattaatgttgacaaacagcagtaaaagtaaaaatccctgtcttgtttccaaatttattggaatggcttcagtatagtctcatgtttgctattggtatttagtaaattattttcttcattcttaagtagttttttaaatccctttttttaattaaaaattttgttaatagtagctgcttaatttcattaaatgcctttttttcttttgctaatataattacatatttttcctttaatttttcatgcaatgaattattgacatccttagtacacagtttttataacatgtaattggactactcagattttgtaactgacatcctggttttaggttgtattttggatagattaggctgttagataatttctggatccatttaacatcttattatagaaaaatgagttggggtaagggagacacaagaccaagcactatcttaataatagtttcttgtcatattttaggccactaaaatggcaatataatttttttttgccctctagggatttaaatttcaaattagaggtagcacaagaacaataaacatacaaggcaaatgagcttatacctatttcatctggagtacagggaaagggaataacagttaattttcagatgaattttacatttgagccaaggaaggccaggggccagagaaagagaagggaagtaaagagagaacttgcttctcgacctgctgctcttgtaactattgtttttctgatgagccagtgacatgattcctgttttcagctgttatccctgtctgggctctatagttaacacatgtacacaacaaacacatttgtcactatgaaaggacaacaacgaatggccatgagtcagtctgtggcgggaggtgtggggagaaaggccttgataggctggggtcttaatttgccatttcccttgttttgagaagtcagtgaaatttgatcagtgaggttagggcagagggctgctggccctaggagcctgcacagaattcccaggatgtggggacagtcctccccgccagagagaaataagaaaaatccaaacagacaccctgtaggctggcagagtagtgcatagattgcccaaataaaaggctttggggtttgtggaaaggttgagaggatattgtggtgagtaaatgtaacatgacacagtcaagtaagagtgaagagacaatggtttccagatccttaaaaaacaccttctgaaggggttaaaagagtttcgaatgccgatagtgctgccgtaggatcactctgggccctgcgacagcctattaggggcccatgcacatgattggtgctcagtgagtattagctggatgaagggatgcatgactcagtgatgaactctgttaaggtgaagtccaaaacagctctgccaagtctgtgttccatagtaccctaaaggtgaagataaatgtgggtgaaaggaggtgaagtcaaaaattatagacaggaattgggggaatgcagcattggtcgtcaatggaggagctctttcctgtgtctaggagcgtggagatgttggctctttcccagtgctttttacatttcccccagagcagcagttccggatgttagaaaggtaggcagctgattcgtagattccaggtttaatgaagaatgtgattctttcacactaaatcatggtttggcctaactattcaaatcactctagggaaggacatgcacagaaggtcaggggtgaaagcggtacctgtcaccccttacacgttaactcacttacttttttccttaagttcacaatgacatacaacataataatagaaacaatattaaaaccagtctatgaccctcactggttttgggaattgatgtgttaatactttatctctacttaatgcttatccattcttaccaattccaggacattacttgaaatgtaaaaaaattggaaaccccaaatttccatatgtctactgtggctgatatttattgctatatctttattacttttctgctatctgtcctaagaaaatgcatttcctatttcactgatttttgagagcttctgttccatttggaaccgcagaagcagcattaagggcataaaatttgttgggaaatggtgcttcttgaagataaagagaccaagaaggagataaaactgcttgataaagacttttaatgcagccaatcagacaggcatcagctatttcatgattatgtttattttcaagatggagaatatatacttctagaaagatatcctaccattttcctttggcagatagaagtagacataactattattaacaggattgtcctacaagtgcaacattgacaaaacataaaatgggaatatgaatccagcttaaataatggctgctttagtaagtaacattcaaataggactttttgttttatatttataatgcaaactagtagtgtgtttaattgtaggttagaaaggtaaatgtgggtcaaggccagctattatagattttatttttcctgagaaaggaagtctctgccaagatatgataaaatatacacactggttccctgtaatttggtaacagataatttcccaggcttccgatctatactactttcaaccacttttaaagctgtgctttttaccaagttgaaataatgaagatagtttaaaacttaacatttgggtttgttttcaaatccttttaggagacagaaaatgatattatttatctttacctttttccttttggaactgacttgcaagaaaatctaacagacaggttgaaaagttgtcctgacagccttcagtaggagccataatgagaccacattattgtacttaagcatttatttccttaaagtttacatctttaaggaagaaactaaatgacttagcttattgaagcttcttagaggttaaaaataaagagcaccttttaaaaatacactctggtccaaaaataggtgtacccatgtataacttttaggcacacgttttattttatgctgagtattaggtcaattactccataacttttctaatggtttgttgagcagttgaaggttttacctgttaacaaatacacctgaagatgtctagaatctgtgaaactaaatttacatgagattcttttccttgtctccatcacattaaatatatgctagagccagaggtaaccagaaaagcatcgaaagggctggtccaagtggctcattcctataatcccaacattttgggaggctgaggcgggagcatcacttgagtctaggagtttgaaaccagcctgggtaacatagcaagacctcatctttacaaaaaatttaaaaattagcctgacatggtggcgagtgcctgtggtcctagctactcaggcggcagaggtgggagggtcaattgagcccaggagttcgaggttacagtgagctatgatggcaccactgcactccagtctgggtgatagaggcagaccctgtctcaaaaaaaagtatcaagatttgtcctctacactaaaatagaattcctcccaccctggtattgttacttgttgcaccctatcattaaaaatatgcaaagttttgtggaaacactatttctttgaagtatgtttcttttctgcttcttttaagtgtgcttgaatttgttattatgccttactgctcacatgatacagatctaaaaaatgcaaggctgacctacatttctgactctggttctggcctgacttgagagccacatgggaagtggctgccgagacaaagtgtacccttcttgcggcaagtgctcggctgggcaaagccctgtctccttcccttggcagaaagctccccttctgctgcagagagccagtcacctggcctagtcaaaaagaaacttggctagtctaagaactatttgtgctttccatggagcaatgagcgatcattttctcttttctatctcgattccctctagcaactcagctcccacctcattcgtcttacctagagcatatcctttctcttggacagagctccaatgccacttttaaaaagataatgaagtgaatttttgagggctgatctttactccttgccatttggcagcccttcttcccaacagagggcaataccccactagccaaacatttcgtgttagaaaactccaagccttcctactggcaggcacttcccatgttggaatcgaggacgtctgattttggtagctcagagtttcccagatctaaagaggacttggcttattagttaaagaactttctaactgaggaggaatgattaccattcagctttaagtaagagtaaaaacgtggctaagattaaaaattaatgtccacataaaagccaagagaattaaaatttagtttcaaatttgacacagagttttctctttggaattgggaaagtatgttttgaaatttcataattatggactaacatttgaaaatttttttcccattttcttagtatctactaaagtgctatgtaactttggcaagcactaagtgtaaacatgcctcatgtcctaagctcctatttttgttttggtttcattttgttgctgttgttatttgttttgtttttgttttctacaggtcatgctgctgttactacaatatgtagccagagtaatgtatcttaacgcttttcatccgtgtaatgggacaatcactaaataattgcaagagcaaaaagcagcttcgatttatgcataacaaagccattccaaattaactgtttattttcacatggcactaactaatctttcttcttgctcctgcctcttgcttggtaggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcataggtgagtgtcagcttcccctggaaggacgtgtcctgtgaaagttttaaccttggttttcaggatttggaaggagggattgatagagtgattctcaccccaagccccctcctgcctctaggctactctgggcaggaatcgccgagtaaaaggaagacattttaacttaatgtgtgatggtctacatttgaggtgctaaaattgttcaatggttactggtggatagcaaattctattctctattaatgaccactgataaaaacaaaatttgctgaggttagtagaactttcccttaagcaagggattctgtgacattcccttagaagcaaagatgcaatgagagacaaggagtttagccaaatttagtatgcaaaaatatcaaaaagtgattcttactgcagcatcttttattcgacagcacatctgtggaagaaaaaaaaaggctagagagaggaagtgaactggtggaagttttgtgaaagtgtttcacatgtggctgtcacatgtgaaatatctttttcgaattgattactctgacatagaactcacaagggacttttagctcaaaaacctctccaagaatttgagaacaggaaaccacgatcctacccaccctactgtaccttgtctgccctgaaaatgtcttcttacccctgtttcttctttccctcccccagggaccagatacacataacttagaattctgggcctcctttgcagactgctggaaaagctgagtttgacaaaaatgtagtgcgttatatagcagttcagatcttactagaattactttatttgcattcagcacagctgttacttcatttatacttctgaaagataactcatagccacatcaaatcccaaatgcatagaatttaaaagtaaacaaaagcgtgtggttggtctcttctttaaaccattgttagtaacaaaaatatagagtttgcactctgtgtgtgtgtgtgtgtgtgcgcgcatatgtgtgctgtaatacattttagtgggacatatgaaagaagtgtattctcaatatgattcaagtaactttgtaagccatattagtcaactttggttttcttcgttggaaaatattgcctttctttacttgacaagtttacgtaaatatttgggggaataaaaatgaataatctccacagggttttatttttcaactctctaatatttaaggagctggcaggattagggacaagtcatgaatttgggtccctttcctacagtataagtcttattgcagcaaaaagtaagcctcatgtagtgacaactaagaacattacaccagtgtgctgttccgttgtacatagagacaactgaaatcaaatggaataataaatctatgcaaaggaagagctctgctatgagaagaattggagaagcagagagcatgttggttttgttggaattggataccatattagtagtggcaaggtgcaaagtggagaattagttaattgatggcaatactgtggtaattttgacataggtcatatgtacctaagcatatatgtgttaacaaagaagtacatgacattttttgacaattacatagatcaataacactaaaatctgtctaatattgtataccaaataatccgaatattttaaaaaatcagtcttttcatgattttgtaaatcatgaaaggtatttttaaagattagcttttacgaatttctattaaaacaagtttaatgttgattatatgactctatcttgttgaattaatcattggagccatctatctagttcttatatcttaaacttctatgtgtaaaactcctggaagcccaaggtcccttcaaaccaaaaggcatagaatccttgtattaattgaaagtctagtttgttcacattagcatttatcaagcaagtggagccttgctgttacataatttatgatatactaaagccttccattataattaatgagataacaaatacagtgtaaattaataatgtacattgtctttaggtacatattgagttctatggatatacacattgacatatattttagccatatagttgggtaagggtttgtatcaggtagcttttgcagcattaaaaaacaaacaaacaaacaaacaaaaaaactactccaaacccaatgacgtaaaataacaattatttactaactgatgattttttgcttgactatgtgggctaggctcaacttggtggttcttctgctggtctccttgtgttcagctggcagatcaactggaggctaattggtcctggatatcctcactcacatgtctggcatttggctgggtgatggggctgactgagccacacatctccagtatctagcaggctagcctgggctttttcacatggtgactggtttctaaaacagaagacagtacagacccccaacatacactttttaagcctttggttatgtcatgttcgctaatacccctttagataagacaagtcatctaaccaagtccagattcaacataccccacctctcgatgggaggtgttgcaaagaatttgtagacatttttattttgcaatctatcatggagctgaaatgaatttaaatatatttataagtaatattagtatttcaaactttagcagtattattgagcctaaagatattcactgtgacctggacttttcaactgaaaactaactgttatggtggaaatgattttgaacaagaaaataaaatttgagatttaataatattccacatgcaatatagagagatagattaactgcttttggtaataaagacatttaatagccatggacaatccggatgtgcctatttgcaaatgtcatgtaattgtcattatatttgatcattaataacatctaaggaaatgaataaaaagaagttcaatgactctgtttcagccaatattatatagtattggacttttgttgtaattcaactattaaacagtttcctggaatatatgtatatagttatatgtgtttataaaatgacaactattcccatatgtgtataatcctattttcatatacacaaagcaatctgttctttagacagaaaacaggtaatgagtatatcacccttcaacctccaaactgctgcttctacaacaacatgtaaatctcattaccaattaagctgcctgcatgagaacccatcaaatgcctccaaagtgctctagcttcctacatctaattataaattgcagaatactaattttggtgtcaatcagtctgaaaaccagtgtgctgcactaacactcactggggggcattgaatatcaatttctcagcctgcctcttgctttgttgaattcattgtcatccaaattgtctattttctttaacattatgtctacaccatgaatactgttttctacttttcaatgtaaagtaatattttctaccaaaaatatcatttgttttacaatatgttaagataaggtaggctacttaaaccaatctatcacttgaaatatttcttttccctttatcaaatgtaaggacttactgaagtaaacttaaaaatttcccgttttttgtacaatatttgtttttactgatcctgttgacccctttatatgtgccaaattctaaatcttagcaattgtccttcatgtctggtcccctcagcaggctgttagcaaacctcccttttctttggtataaaagcaaacctgggttcaagtttgattctgcctcactacctgtgtgagactttgaataaataatttaccctttctaggcctctattttctcatttataaaatgggatcataccatctaggatggctgtgaggattgaactaaatggtgctcagcacattgctgagacttactcagtgcccagtaaatgctgactcctggtctgtgcgttcacttacaatatcatcacaaacatggtgacattcatgagttgttctctgtgattaatggctatttcctttaagccaagactttgacattttaaaaacgaattttagaggaaatcttcccctttgtatacatatatactgaggataatttaacattgttcagtgactctgagatgtcagggagaagcagattaatgtgggaaagctagatccctggagtcacatccgctgtgtatcacctgtggcattttcacttattcattcaatctgcatttactgtgggcctaccatgtgcccgtgaaaggtggcaaaacagatttaattctggccctcctggaactcacagtgtagaagagaaagaagacattaaaggactggaaaaataaacagaattatagattgtgaaaagtgagatgggaagaaggatcagggtggtaaggaagagtgtaagtggagagacctaccttcaatttgggtggacagggaaggtttctttgaggaagggatgtttaagctgagactggaaagacaaactggagagagataggcagagagtaaggaaactgcatcctaagaacatggaatagcccatgtggacgcccctaaattgaaaaaaaaaaatgatgcttttacaaactaggagaaatccaatgtggtcaagcatagcaataaagagagaataatgatgaaagaagaggttgaggagtaggcagtggccagatgatgaggccccacgggctgtatttagggtgattgtatatcaggtttcacaaggatagtctggtttaggcctgttgtcctagtataattattagcagctctctcttcactcttaaaaatgccctggtttagacaataaattgtatagtcactgtagctatattaaacagtctggatttttttctaagggtagtggggagcctttgcagagttttaagaaggagaatgatatgatttactctttaggtgataaggcatgagtggagatgggcagcacagttggaaggctgttcaggaggtgaggagatagatggcattggctggagcagaatgaggacagtaaagataaagggatgtgggtggattcaaaatatattttggagttagaatggttaaattctagtgatgaggcagaagaagttatcaagaataactcctaggccaggcatggtggctcacgcttataatcccagcactttgggaggctgagacgggcagatcacttgaggtcaggagttcaagatcagcctggccaaaatggtgaaattccatctctactaaaaatacaaaaattagctgggcatggggcacacgcctgtaatcccagctactcgggaggctgaggcagaagaatcacttgaatggtggagattgtagtgagctgagatcgtgccactgcactccagcctgggcgacagagaaagactccatctcaaaaaaaaaaaaaaaaaaaaagaataacttctagataaactaagtgactgatggtgctatttatggaaatttggacaattaggggtagatactgagggaaagaacaagggctcagtttttgtttttgtttttgtttttggttttgtttttgagacggagtctcgctctgtccccaggctggagtgcagtggcgtgatcttggctcactgcaagctccacctcccaggttcacaccattctcctgcctcagcctcctgagtagctgggactacagatgcccaccaccacgccccgctaattttttgtgttttttagtagagacgaggtttcaccgtgttagccaggatggtctagatctcctgacctcgtgatccgcccgcctcagcctcccaaagtgctgggattacaagtttgagccaccatgcctggcccaagggctcagtttttgacatgttaagtttgagatgccgtggagatgccatgtgactgctcaaggataagaaattggcccaaggataatagaagataagcagacttgagtagttctaagtagatctgagactcacgctctggtcctgtgaatctaaacctacactcaagaaaccaccttatatgtagagctgtacttaggtattcttcatgccatgttttctgagtgtttgatgaatttctaggcccttgcctgtgaacactaaggtgcagcagggttctaaaagtatatttaaataaaattccaaaaatgagcaccaaactgttcaacccacaggaattttctgaacaaggaggaggaggaatataggatataagattatggggcgtggctgagaccctcacttggcagactaggacatcaggcccaaggaagctgtatttcactgaggctacttaggtagtgggagaactgggattacatcctcagtcttcatccctcccaggttgtcattctttccaagagtagaaaatctatgaacagtcctctgatgggaggtcacttagcaaatgtatggatatgacacaggtgtttgtttttggccctagttaagggagggttttagctccatcaggcaaggaagaccatctttaaacagtcttcctcttgtcaggagaactagtttgattgttaagattttctagtggtgagaagcacatgtgttttgagccagcatgccacagagggccctattgtgtcaactcacttacgcgtgcatctcagcgcagctgatatgtccatttgctatggagcaacagctggttgcctggtgggtcaatgcggctgctgtttcaggtggagacagctgccagctaccaggtatagggaactgagaggagaaacaggctgacaaggtcactgcttttggtgttcctgggacatcatactagttaactggtttggtattgtccattggatggagtttttttagctcctctcatagagttgacctcttacaaaattagtgcattcaatttaagagaattaaaaagaatttcagacaaaaggatgtggttgtaatacatcctgctagagatgatgctgatgatgctgatttcatacaacattcctgtagtacccatcaggtttcagccaattaattaaatcataccaagcctgggaatgaagtttgaattattctgcatggaattacccacacatttagtgatcattgctaaagcaacatttgcacagaagttgggtgtcatgtttaccccaaagtgacttattcctttcatccatgtctctcagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaagtgagtgactagggctctggaggaaggagaagaggggtgcagtgtgaagcatctcaataccatgatttatatgacctccagtgaaatacagtgaatgtgctaaagtcatccacatcattaaagagagagagaaaatgaggggaaaaatgctaatagagatataaggaattaccttagaataatgactgcgaaaactggtaaaactataaatgtggcattaatttttaatataaacacatgtcagaaagcatattataattattccttaagtaatttattttattgtgttttataggtgacaaagaagttacttttccaagtagattattattgttgacagcttttgtttttaattccacaaaatttgaagacacatcgagttagcatttgtaatgtatttacattctgtagttggtagtacataagtttttaggtccctttgaaaatccagaccctataaatatgtctatattccatgcataatagagcagaattttgcttacagtttctaagatttcatagtgataggctaggaatctttgctttaaaggagaatgtgttgttcttgaattattccttcccattttaaagagcacattgaactatgaagaatgttgatgattattccagagcacataatgtagaactggtggatcataaggtcacagagctgagaggatctttaaagggttttctaacctatgtcataaccctttggttcagcccttgaattagctttgtcttaagagtcccttctgttttgaaaggagatgacctccagttgcctttggtagcttaattctgcctttaatgctccctgtcggataaagtgaatcatgttgctgaatgtgttctgttgttgctttgctttacctactaaaaatattacatatcatacaaggatatctaggaagggttgagatctaatgtatagtttatattgatgtttatttattgagagtaattttacagatacaatttatttttatatatctacttgtctgagcaatgaaaaagggtttttattgttgttttgttttagttctgctatgaaggcaaagctaatgtaggtgcaagcttttttggatcccatttaataatatatcctaaacatagaccagctagtgttgcccttaaatttctaaaatttgtatagtggtgacattatgacaaaattttaaaaatacagtgtgttaaaattagagaggaagtataattagcattgccaagatatatttttgtttatttgtgttggccttatttcagttggcaaaattgaatgcattttgctacttgtgcctgtctagggaattgactgctctaccccatgccctctgggaacctatgggataaactgttcctctcgctgtggctgtaaaaatgatgcagtctgctctcctgtggacgggtcttgtacttgcaaggcaggtaagaatgggtaaataagtctttaatttgatcctggtcacgttatctcctaaagacacaaaaaagaaaaaccttaaccagggttctagctccagttgcaccaaaattcagtgtctgacctccgcaagcccctcatccagtatgggctggaacgctttcctgagtgaagggaagaggctcacattagatgatctctgaagtcactgccagctccaaaagtctctgtgtctgtgcacttttgggaagagtaaacaagcagacatgtgttcatgcccctaaattgactggcttggaatcatgacaagaaacgcagccaagcaccaattttatatgagcactagaacgtgtccatccataggtgcagccaggatcctggatatacacagttgctggttaatggggtcctgctttaaagatggtgttgtgttttcaagcagaatcctttgtctcccttccatataaatatttcactttcctgatctgaacaaaactcagcattccacagtgtgcatcactgcccattaaaggtgctttgactctatatctctttttcagtagcccactagtatgcagtgctggcatcctcgacagatcacacaacacacatggctgtttgggtcgtcaggggtgccttctgttcatttctgatggaggcctaacttggcagaaccagtgttctctgctgctgtggctggggcttgcatctccaaggcgtttctaaagagaaacgtggtttggaaaggctcaacaaggctctctgctgcctttgttcgctcacgtgctctggcgttcttgtcgcacaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggtatgcacaaatcagcgccctgacggaaaacgcctatgaggaactgatgttgtaaagttggcttctttttgcatttttcctgacttcaagtggctcactgtgaacccaacttcggtaactactggaagaatccaggtatttggattcaaattggacgtaggattggaaaagagatagacatggaaactggttagataggctctgcgagaatttcttccttcttttccttcatcttgttcagtttcctcaacccccaccctttactttctgtttcttattcacccatctcttggtggcagccagtgaacagtactggtctccaaatattttgtttccactatcatggaaatctccctgcctttatggtagaaagtggcagggagttgaaaggagggtggtgactgatgtcatagaaatgctcatggaagtgttgaaagaaggtttggaaacaatgtcttttaacataagtatctctggagccacaaaaatttcttaagatgtccctatagctcactctattcccttgacctactttggagatacaggtcattagaaatctcatactgcatctacctcaagctgtcagggagtgcaaacgggaagtgcattctggagtaagctgctgatttcttttccatcactctttctttctatagcaattattttctcctgagccattaggcattctctctgtggtgtgtgttctctgcctccaggacatcatctgatggcgagttaacaatgtgaccccctgaactgggcccctcgagaagggccttccacaatgctcttgtctctctgggcttcctcctcattaagtacaacccacttcccaaaatagaaaggatcccactcatggatatcccatggacagagctgtcagctttgctgcctctcatcactctagtgaacaaattatcagtacttggagatgagcttgaagatcactttttactccctatctgattgtagacaaagcaaagcccctggcacaatctcgtcctttttcataccttagaggagttagtaaatcagtgaaggctgagggtttagtggttcatatcatgacaaaactaaatcctgtgtagctgtatcaaacattggtggggtctacaaaatgattgttttctttttcttattttaacaagttctagacaaataattattcatctagcacccactacctgtctatgctggttcccatgttcctcctctgtggtaattctgtacccctgtttctcttagttcttgggtggtgttgggaaggcttgtagtgcctccctcatttcccaggatctgtggtgaaagagctgaactttccattctttctccataaacaaaacaatcatgtctatgaggagtcttgtctccatcagaccatccaaactgacgtgcacatgaaagtataaaagatctggaaggggaggagcaaggaggtgtgtcaactcatacttaggactgtgagtcaggatattttgtgtggcttagacttcttcctgaaaagcaggataataatcagagaaaagtaacaaaatatcttcatttttctttatagtaccatgtatctcgttggcaacttatggcaatgaacttaattcaattaaaactataatttttaagattagtttataatttaaaatttttttaaattataaatttttttatattttataaaatataaataggcaggagaatggtgtgaacccgggaggcagagcttgcagtgagccgagatagcgccactgccgtccggcctgggtgaaagagtgagactccgtctcaaaaaaaaaaaaaaaaaaaatgaccctgacccacacaaaaaagctctaaaattatagttttaaaactataattttataatttaaaaaatttttaaagtgtgttggcatgattggcttcactatttatatgtcccaaccgttgtgtcaggcataaactagggtttgagtgactttaaaacactgacttcctggagcctatattttggggactaagaagacatagaaagaggtgattaagatgcatccctctggctgggtgcggtggctcacgcctgtaatccaaacactttgggaggctgaggcgagtggatcacctgaggtcaggagttcgagaccagcctgaccaacaaggtgaaaccctgtctctactaaaaatacaaaaattagcctggcaaggtggcaggtgcctatagtcccagctactcgggaggctgagaattccttcaacccgggaggccgaggttgcgctgagctgaaatcacaccactgcactccagtctgggcaacagagcgagactccatctcaaaaaaaaagaaaaaaataaataaagatacatccctgtaagaagcgtttgggacagcagggtactgtatgtgaaatggctgacagtggccttttcctcttctgttgtgggatttcccaggccctcattgctgcctttgatgctgttttccatgcaggatggcacgtacgggctgaactgtgctgagcgctgcgactgcagccacgcagatggctgccaccctaccacgggccattgccgctgcctccccggatggtcaggtgagagccaaggaccgctaattgaaaggtgaaacccgccaatttaacacctagtgctgttccttatcacttcacagaaacacacaccagtcaacttttcaaaaaaaatgaaaattcgataaggtttccagtaaactgaaacctttaatctataatccaggactgattttttgttgatttgtgtaggggcagttctcttgagctacaagtaaggtccagctgtcaaaattcaggccagcaagatggggaaaatgtgaattgctttgaagagttcagcaagaccactgtggtatattttgagcactgaagaaagaatgattgaaataaaccctaaaaatatgacaagggtcaccttagtgaggcaaaaaaatacagatattaatatggtgaatatgcatatgcatattattgtatggttaatatgcaaatattaaaatgttcattgctggaagtaaaagttttaaaactttctttttttacgataatgttctggtcatgacaaattcataatatgactgagtacaaattctgtaaccacagggtgggagtttctccttatttatatagcttcaccgtttcagccaggaagtttatcaagctaaaagtgatactgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtcatgtgcttgatttctagtgtctgagagctaccttgggaaacaggctaaggctggtgcaatggactttattttctaccaataggagctacccacagacacgaggcctccccaaccctgtagttccatcttgacttgcaaaacctgagataacttgacttcacaataggaaattctgccttccaatgtttcagcttggctcttcatccccaaatgttaaaactgcatcaactagggattgaaccagattttgtgacttcactagggttcttgaagttctcaaatggagagatcgatactaatttctcaatgaccacggtgaagcaaaataacatttttaaccttctggcaaattcagaattttctaacagagagaccacatcatttgttttatacaacactccaccaaatctacttctgtcttataaagatagaaagaatgtgaggtgttcctgaacacaccagtcactgctcaagtgtccacctgctttgatgatttagaactatcctgtgaaaggcacactctagtatacatgagaagagcaagagataggatttggcctgaagccagccggaaaatgtgttagttgcattccacagtctgggtcatggggtaagacaaattatcccatctgaccttagacctatcaagctcctacgggaatgcagtggctttgtcacacaatgtaatcttgtaatcctctgtccatctgtggccggcctgcttctctaaacgggaagactactgcttcatgctgctctattgcttgttgcctaccatctctgcctcatggtctgtcagtcattattgctcctagaccagctaagttgccccagtgtctcatttctgggtcttctgtgtgggctgttggtctgtaagcatctgtcagtatctaagcctgctgtgaggtcatccctcacaattacagaatacacttggtatacaaaaacacatgtagaggaaaagaaaattactgaagttccaaaaaacacctacaattggaccaagaattggcttatttttttttttaaagaaagagcagcttctgtatattatttacaaaggtcatcatttcattgtctgcactggacagactaataattttttacccataaaattgtttagggttagtaccctgttaggacctttttgaacgtaaagaaggttttactttccatttaagacaccaggtttgaggtcaaaagataaacataagcccagagaagcaagcaattctatttcttctcatccctgttgctgagattgctgtaggtgaaatattaagtatccctggacagggcagaagtatgtaggataggaggcttgtgtgtagtgaggcttttatgaataaatcagtgaaatctgacacagaagccagggctcttcccctgatcaaatcaacaagatggccttaagtgctccgtcaactgtggacactgtggggagaggctgatcagttggatttggagccagagataagagtcaggagggccttgttcctctttacaaaggaattgacatgactaaattgaggaagtctcaccctaaggtgagatgccaaggaagatggcttgctgtcttactgtgtacccacatccaccatttcttataacttcaacccactatctagcatttgactgttctctcaaaggaactgaggcttttttatttctattataattgatagtcctattttacctagtcataaaataagtcctcaaaatatactgttatgaaaagtaaacaaaataaaagttgtgtttgacattttagatcctatttccaaaaaaagtaccattttattgtagtatgtggttatttaaaaccttaatttattgtcatttttagccaatacactattttatcaaaaagaggcagattgcagtagaagaatgaggaaaatgaaataccattcaggatttaggctgtgtcctatgctgcttctcctacacctctggacctctggtacacacacacactctctctctctctctgctataaaatgaggctcgcttttcaaaatgattatactgaaatttcagatgtcaatgaaatataattatgagtgtttgtgtatacttatgtatgtgtgtttccagagtagtggagtgatatactttataaaagcattttcccaaaattacagaaacaggctgaagtttatgtcttcttttctgctctgacttcagtcagccagaacacccatttgctgagcattacagctaatcaagatttcattccagctgactgggaacatgtgcagtgtccggcctcattcccagccctggctaagatcactgtcacctgggaactcttcgaacttgcatattcccagtccccacctcacacctactaaatgagaatttggaaagtggctgaggaggaggaagattatggagcctctgcccatccagaaagcaactttgatacaaatttggaaaagatttggaaatccctcaggatgtactccttggcacatgaagtgcaagccggatttctgccccaacttagccccttgggcaggggctcttgcatagtgcacaacttgcaaaaccttacttggtggctttgtctgccctggtgacccaggcaggcagtggcagttacggtctgcatagtggcatctgctgtgtcatattactctagttattgaagaacttggggtctggggtgcatttctttgacagaaaccacataatcaatggcaaatgagaagaggtggttcaaggatgtgtttataccagaataaaaaagttaaacactaaacagataaaaaggagaataggacacccaatgaaactctaggggtcttgagaaagagaggagagactatcaaggcatggtataattgtaaggggaggggtaggagaataagaggagaggttgggggctcatctgagcccagccaggaagggtgtaatcggaaggaggatcacctgtgggcaagttgatgtgaagagcccacttctccgctcttcccagcaagcagaactaggcctagagtggccgcagcctccctccacaaggaaagctctcctttccatgttttaccaaacagcaagtttgaccagctgagtgagtgagctgctacttcagggactaatctgtcgtgaggtgatgtctcatgcagctaagggatgcctgaactgttaaaataaggggagacctaccttcctttgtccagtgacatataagtgcaaatccaagttggaggtaataactttagtcaaatgagtttaattaacatgcctgcacccaatcagccacaagtacaaatgactcactatctgacccttttgggtattgagggctggagagtgtgtctgcaggttcatatgtatatgtctgtctgtttggtcttgggagaggggatcatataaaagcagaaggctgggcccctgctgtgagggtgaagggaggtgctcatttcccccaacaagaaaaggccacagaaaaaaccaaagctccaagatctgcctagcaatcctttctacttgcttttatctgggtccagactgaggcaggccatggtgtctggtatttttttttttttttttttttttgtcttgcaagtgcaaaggcaaacacctctgatttatatgacttattaagacttttttcaactttgttgaactatataaagcagattcttttttactgggtctttaaaatccatagtatccaaatagaaagatttggtttaacaaccatttgttgagtgtctccaggttctatgcaaccataatgcttgggtgctgggaacacagagaggaagtgaagccaactcccatcctgcagaagctcacattgcatcaggacagtcgctctatcagcagagatggatataccagtgaataacttctctatactacaccacactatgctgtactacactacactacgctacactacactacactacactatgccactgctttgttggtcaaaggattagaaaagcagaaaaagtgttgtgactaaatactatagttcctccatcttataattaccaagcccaattattattaacaaatatctctctttgctctaatatatgtttaatagcttgttgcccaggaactagacatagaatcaaaataatttccttcattcactaacgctccaaatattggaatactggcataaggaatataagcaattaagtaagacaaggatttggggttatatctatgagaggggaaagaatgacaccccagatgatttatttactgcattcatgcaatcacaaatgcccagtgaatgctgatttcacattgaggccgctggcataatgcatcaggcattaattgcacgaacatttctttagagctgcttagctgaagtttatcacgatcattcagccattgcctagcaacttgtggaggctatcaaagagctctttgttctcagtcgtggcaaaaacagtcccttacagatctccttatcagcattagaacatttatcagaaaagaaatgctcccattgaaccagagatggctgcagatttaaacctacccccttcccacgttgccccttcttcccaatattttagaagttatttcctgaactattaaagtttctatctgttttttgctaaaacttctgaaggaatttccttaagatgtcatataattcctttatggcctaataatctgggcttacatgtaaaaacacagacctgagcccctaaatgtgtatctgctcaagaataagcaaggcagacatctccacctccttagcagggaagggtcaccatttttgatatacaacctataaatatgttgggcttcctggtttgagtgaagacttattcaggaaagcaaagaatgctgtggttgctccatcccattggaaagtggtcctgaatatcatacaggaaataggaattatgtgtatcgattcattcaacaaataaatttatttaacacctcccatgtgctaggtgctatggtgagcaaaaacaggcattgtctctccctcagggagctgccagaattaattacctttggtggagaattggaggggagtcttcatctgcattttcttctatatctctccagaattcctcttccccgcatctctgctgacattgacttagtttcatgccttgtcactttgatcattttttttatttggggaaccccaaatgggggttctgcaggtaaaagagcacctgacaggttttctttcttcccaggctcaacatcttctggccatcttctgccctcctataaagcacaaatttagttgtgccccttccttcttaaaattgttcatttggtccctgttaacaccagggggaggttcacactctatagcatggcgctcttggctcaactcaacttggccactgcttggctgcccagatgtctcacctgctctccccagcccctgagttttagctgtacccaacacttgcaattcccaaaggacagacacttctttgggcctctgagccttgccaccactgttcccttagcctgcagtcctcttcccccttcacaagctacctcccttcctgatcatgatccccaggcagagcagggtgtgcctgttctgtggtcattatcaccctggggttacatttttaagaaaacttctcacagcaaaccagtagctggccagatcccttgaatgtttgctgagttgggtttccttttctgcctttgacaaacaaagaaacaaaaagatgttttgtaggaccctagcaaagctggcaaaaaataagaggagataaatataaataatacacatgtacccacacagagccagaaataatggttaaagcaaaacttacaactcttcatcctggagaatatttcattgcagggttatccttacatggaagtcacatcagcagtcatatacctggtgcgacttagagaaacacttacccaacactctcttagtgatacttactgcctgaaattccacaattagatatttatttcttaggctcttagaatgcatgctctcttagaatatcaatattctccagagaaggtactactcagcaataataaatgtatcttgtccttttctgactgtaagatgaagggaaaaataactaggagggcacagagggccagaaggggagaagcagcaataggagaagagggtacagcaagaggaggaaagacaactccacacctttccctggaattgccccctaactgagacatacttgatatttatcttcacatagattaggcattagtatctgcaaaatgctgactcattttttactgatgacagagtaaataaaagggcttgaatttttaagagggtgttggtaatagaatttttataatttatattcaaaggaaacatttctttgcaattctaaactaaaagttattttcaagtaagcttgggtctgttgaaagatgcttatatgattggacacagaaggtttgatcaatgatctatagaatttgctatgattctctggaaatgaaatgatgggtaaaccatatgaaacaagcttatctctgcagtggatcttcttgctatagggtgggccttgttacttatacaaacattaccaggatatagttgattatgactgatggctaggctaatcagctgaacaaacctcttaagggaagaagaataagttatgaaagagaggatctctttattcagatttgcctatctggcctgtagtcatttttcttaccatgctctgattgagaataggctaagctatacataaatcatgataacctatgatataaaaaagcagcaaatacttttgacctaaagtgtactccattccatcttaactgaatttattaagtgcaatttgaagtagtgatttggcaagtagttgataaactaagtcatcataaatggctaaatcttacctgtcccccaagtccccaccctaacaaaaaagcataaaaaatcgggactgctttttcaggatgatgatcagtcagattaacaggataattactcagtttccacttcttcaaaatcttcgttgggatttgtcttgatggcatcagaccaaaatgccctgggttgattgtctaagtctctgtgataagcaggtgtccccatcttagctgttgttaagcaggagtcttggctcacggtcagagtctaggacctgaatttgaactgagagcgaagtgtttagcaggttacccttgttggtactttctttaaattctcaaaacaaagtttaggtttgcagcctcattttgaagtggtttactgcttaatatgtttgatgcttctgcccagtataggtgtggatataaattccaggtaagattctgtggctgatgtatcacatctggtgagggtagagtttgcaatttcatctcagattttcaaaagagatttgaaaaaaaaataatatatttatgattgcaagaaaaaaatcaacatagtaggcccagatttcatactttattctatgggaaacatttaaaccccaattggtttatgaacagacctggtctcctttcttcagcccatggtccgaatgaaataaaagtctattgttgggtcaagctagacacaatgaggtctgcatgctttcttgcctatttaatggcctttaccacgtgggagactttcagaaggaaaaaaacaggaacagtaaaaagtggatcttcttgctattccagtgttcaccggaaatggtgtaccaattaacaacattcacattatagtttgggactgcttccatgttaaggttcagactgtggtgactttttgcctgattactttagaagccaaaactgtaacacaagacatgaccgtctcagcatcgtggtactgggtggttgttagtattctggaatcctggagggtctgcgtgcttgctcttaatgtgttttcatttggtctgaggccagcaactgccagttcactactaattataacttattgcctttcaatgtgaagaacatttctttgagttgtgaggaattctggcaagaaagaggcccctgttgtatttccaatacgaatgtacagaagagacttttatttatctcaaataaaacctggttttagttttatttttgcaaacttagctttcctttctgtttccttttgtcattttttttaattctaaagtttctcagtatttaaaattagagttaaacaactgcatacagtttcataataatcgatagcatagacaacagctacaaataatgtcagttgtgatattctgccaatatctctccaatgtcaggtaagatttttaaggaggaatttggtggcacgtgtcagtgcatctttctgttctgcacaatgcaccatcaagttattttaagattatgtttatttgtttcatccaggggagggttttctttatgtaaaacattttatggaactgttcattgccttatccttttacactttatttctctgtgaaaacaaagaatgggaggaggaggaggaagtcaccaagggctaaaagatatcgtattgttgataaattttacttgcaatagacagagcccttgggcttccactttattgcctcctcctgaagaagaaaaatcaatataacaaaagtttgttattcgttcttcatgactccatagaaaatcggtctgggtattattttaatgttatgatactgtgtattgatgtttataagatggtaactctccattcattgctgctggtgatcctcaggtttaacactgtgagcttagtcctcatctatgaattagcatctgcggaaactccgcactgcctctcactcagccttgccccatgtgcattatttcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggagtaagtgtctcattaggcagtaatttccaccttcccttccctgggcaccatgtatcgaataatgatctctgtcccacctctcagtttatagtgatgtcctgttgcagttgaaggcaaaagagagtgtaatggttcacttgtcctttgcagaactgtgttccctaagagcttcattctttccagccttcagaactaacctaacagatggggatttaaccatttcttctcaataattacttcattgcctcattggcacaaccatcaggatatatttcttcacccttcctgaaagctttggaatggtgttctagaaattcactgacctgtaaatatgttattcagcagtttggcattggccttacctcaattaccagacgtcaacatcagccaaaccttgaggcaaatcattcatcctgctagtagtcttaaaatcagtgctatggggaaaatggaattgcaaagttgaaaaaggagactgttgacattggtccttaagacttctgagttagaagattaagtaatcttttagtaaatgcaatcaaaaaagaatatgtaactaattataagttatactattctaattttttaaattgcctttccccccataagaattctatgcagttatcatatatttaaatctgaatagtatcttggcaagaacttaagtatatagcattttggttaatcacttttcgattacagtcattaacctggaccattttgaggaggaaaaatcttcaaattttgactgttgatcgatttttattgccagaaacgactcttaaagaataaagaatcaacaaatggtttgagagtacttatttgagacttattagtatttcaatttttttatctctttatttattcaatgaaaattcctggagccctgctttatgccaagacttgagctaactggggccttaaatgggaaaataaagaagactaagacatttgcttgctctcaagaaactcagagtttagtggcttcttttcctcattaaagggttcctttgttcctttgttgttcttgttttctacttggaaaattctccgtatcttttttacttttttttaaggttttgctttttaacctctaaaactttaactagatcccgatctggaatgcgagacaaacgcatctcagaaggataactgctgatttcccttctgttttcagtctgctcccctggtttttatgggcatcgctgcagccagacatgcccacagtgcgttcacagcagcgggccctgccaccacatcaccggcctgtgtgactgcttgcctggcttcacaggcgccctctgcaatgaaggtaaggcacgaagcatcccggacagctgggtggtgatgagcacgccccggagagtctgtcctcaggcctccccttggccttcctgaaggccatgttttcagctgtctgctgggaatgtcttctgctgtgctgtgtctgcagcttctcagataggactttgagctttggaaaagctggcttgccactccagcaaaacctttttatttcctgagatgtgctactcttcagttttagctggacatgtcctcccataaaaaatcaatatgcggaagaattttagactcccagagcaagaagtcgtgaagtcatatttctagaagtgcaatgatgtcccctggtttgtgatgccttaatgcaaatctttggcttcatggatttgtaaaaatgagcccattcaagatgaaggatgctgttgagcagagatagctaccaatgagcagctgggcctgtgacctttaaagttatttcctgtgctaagattctagggttctgcgagaggggttttgattgtgagttactgacctatagcttattcacagtgtgtcccagtggcagatttgggaaaaactgtgcaggaatttgtacctgcaccaacaacggaacctgtaaccccattgacagatcttgtcagtgttaccccggttggattggcagtgactgctctcaacgtaagtcttgtttgagaacaattaataaactgttcttatttgtttgttttcagattctttaggattgaagtatgagtgtttttatataatcaagaaagaatatatgactaattaaaagacacattctactttaaattctttttttaaaattctttttttttttcccattacgacctctatgcaatggtcctatgtttaaatccaaataatgtcttggaaagaacctaaatatgtaacattttccttatccccttttcagtgattcatcgtccattgaaataaagcaaaaacagctgtattgagaaatctatctcttcattttgtgtttatctggagagttaattacagagaaagaaaaaatggaattaaatgatgtgagccttagaaacctattgggaacctgagcgaactgcccacctaatatgcttagcttcaccttggcatcacccaagtgccttccacaccactggatttcagacaggaattgtgtgaccctataagggactatatagatgactcttagagcacccatgtcatgaaaaaaatgacatcgactataagtcattcatgaatgttttgaaagggtcagtgcaatgtctaaaagtattcaacttttgaccaaaaaatagcatatgtatggagtaatctggtttcattcattttaaattttatgaaacactctcagtttatattgaattcccccatcatgcacataagagaaatcaaagaatgactgtgtgcagtcattttacatggtgctttattgataatttaattcaaacttcacagttacaagcaacctgcaaatactaattgatgagcaatatattttttgctggaagatttttttctgaatgttaattttttccataagtagtccaggctgtaccccattttttaggaataagggaagagagctaataaatctcagaagtgtagctctttggtgaaagaagtgttatgcgatatgatttcactccattctgggggcatcacttcagaagaaatcagtctgtttaaatctacatgtgttgcaagggctctgactgatggttgggcgtatgggtttgggaagagtaaaaggtccaatatcattgtcacaaaatgattgatttatattgctcctttaaaaagtagtctttattttggaaatttgtcccttcctcatttggaggaggaatgtgctgaaaggaataaaaatagaaacacaactatgaatggagactatagtgttgcctgtcccaataatcactccacaggaagctgacttatttggcaaaagcctttgcttctcctggggatcattgatttcattgattcccttatggactctgtggaaccatcttcatatttcttcttagctgattgtgagcctgtctaaagagagcaaagtccttcacagtgaaaacacagactttgaaaacttaaaggggtacatttaaaggggcaggtgtccttgggaaaatgattttttaaagcactatctctacgtttaccttttgggaatataaagttgagtgatgcttattcccattctctgatcataacaaatatagggagaaaaacctaatggcagtgggttacctcagaaaaatatattgtgaacataaatgggtttacagaagctggttaaatatcatctaaggaataggttgttttaggtaaagagtgcttcactgagcatcaaatgggctagacgcttcaacagttttcactgagtctcactgtggctttgggaaagctgtatttgtctaacaaataacaaatattattattaatctatgtgaccttgtacgagtcactattaaccttttgtgtgctcagtttcttcatctgtaaaattaaggtgttgtatttagaaaatttgttccaatgctcactcgagacctcaagtgtcagctagtattttccccttgctcttggacatggtgcacacaattatggaagaatttttttcatttaaaaagttacttcatatgtattattgattgtctttataggtccacattccctatggggtagccgtatagaaattacaggtggtcctccttttatgcaattatgttcctaaagtattaatatgaataaaaagtattttttgtcaatgaaattattttaccccctgatcttatgctattatttcacagatactttatctgactttctgatgtctcttcaatcggcagtgacccctaatgatttaattgtattattttctggatcttccagttaagagtttttacaaggaaaccaatttttacataccgctgggaacctcaatatttaaaaggagcctgaagtggcaactctagagtagactgaagggtacaggatttagaaattgtgaacatgagctacatggccttgggtcctttaacctctcttgagtcaagtcattttccacaccttatctctgctcaaatgtcctctcctcacagaggccttcctcagaggagtagctcccaaaattattgtcttccttatcctccttatgttttttcataatacctaccaccattgatttttcattttgttggttggttggttggtttgcctgcctcccctaccaaaatagaagcttccagaggatggtttggactttgtcttatactctgctatctcccttgggcctggaacagtgttgggtacataataggtgttgaatatgtgtttgtttaataactgaatctgtaaacttgaggtgatttttgccccagccacctcactctgcagttgtaaatgaatacatatgtcaataatgacagtcgttgttgaagttgccatggccatctgggatttagtgcagaattcagagcagtgtgctttcttagtcctgatgtacactgctaacctctcacatgcagggagatgtgtagaggtggatggaattctccctacttagtattggcctcagaactctgatggacttctccatacctgtaatttcagcatgtccacctgcccactggggcccaaactgcatccacacgtgcaactgccataatggagctttctgcagcgcctacgatggggaatgtaaatgcactcctggctggacagggctctactgcactcagagtaagtgacaagccttctgaggctcaccaaggggagccttgtccaaggaggaaacagccttaccctccgcatgcgtgactggagctcaacaaaggtccctgaggttggagtacttccctctcctaatgacctgtagacatataaatttctctaagtgattaagagctacttcattccaagtattctgtctctaggttctatctccactgaggtagagcaatgctgtgtgatggtatgcagtttatttctcttctctcctttaaccaaatcatatttatatggatcaaattctcaatcctttaacagcacaaaagttaggataagtatagagattagaaaggtagagaagacaacaagcctcactgcctgatttaatgtgcgctcttggaaaaggtggagttccgtgtttttcgaatggtagcaagcttcagaatcacctggaggacacaacaaacacagaagctagttccatccccagaaagccggaagcagcgagtctgggctggcacctgagaattgccatttttatcaactggtagtaatgccaggctgggaccatgctttgagagccactgccctagttcttttccccattttgtaattcatagcatcctaaccattttttcttccattaggcttttagcatgataggatatagtgtgcaaagtacttactccaaagctgagcatcattggggaaggaagatcattctctgacctcttaccttcggttgaataaaggagacaagaaaggaaggcatgtgttatggttaagtactaataatagcgtatattttaaaataatagcaagaagctgaggaggacagatgggtctgaaattgagcaattcttatttaatactaattagagtacataattaaagaataggctgaaaaagtcttagaaactttctagaagataatgtagaccttgaaccaagagttgaaaaggataattggcaaggaaggtagctggcccaagcatattcttcagagttcgtatatctataaatattgtttaacttcttagagaaaggtacttgtaagatattatttataattctaaaattagaacgtgcttcaaagagagaaccctttttcaagtgcaagtaacatgatatagtgggaacaacatggggtccagagccagacctccctgtgtttgaatcatggccctgccgtcctgccagttgccagctgtgtgacttagggtacttggggcttagttcctgtctacaagacgggaatatccatccctgcatttctggcctgctgtaaagattaaacaagagaacgcatgaaaagaatctggcacagagtaggtgctaaataaatgcatgacagcagggagtcatcggtgcatactggcatctgggcactgcctctgcttcttgaaagttccataagaaaatgagaaaatgaaaagcatatgtaatatttggaaacaatcattgaatcagcctgcattgaatctttcatcacgccagagatccccaagacactcttgcagggcagctgccagcccatgtaagccaacagaatttgtgggtgtctttagctcaagagactcgccggtctaagcattgaaaatcatgcagcagtgtgaagggttattgctttttacaaagcacctgtgaagtacaattgttttttaaggtaagcattctagtacacctcttcagggaagttgatattatctaagataataacagatacagtggacaaggctagtagcaacaatagagatgttctgtactacaagtaaaagcatacaggtaattttaatataaagtacccgtctcagtccattggaatttgagtccaggattctagtagaaatgtgaaagaatgaaaggaaatgtcctattcttccaggattgaagggatattttgttagaaggcactagtcttgcctccaggggtaccagtgatggttacactgacaggaatggaactcttctgcctcctgcttatgaattacaacctccttgcaagagccctgtcttgggacttcaaagaagctcttgtggcaagctcagatatgtactattcactgtattctctgatggctcagtgtcattcaagtttaaacacaaatatgttggaggcacgagcctccaagtgtttctcttcagcagcctcttgactcctactgtcctccctcctcccacaggatgtcctctagggttttatggaaaagattgtgcactgatatgccaatgtcaaaacggagctgactgcgaccacatttctgggcagtgtacttgccgcactggattcatgggacggcactgtgagcagagtaagtatgagagtgtggcatcactgggtggtatttttttcctctagaatcacatttcctagatgccaggaaatattaaggcagaattcaccactccgaggttgtttgagctgatggctggttacttctcagcatgactgacttcccctcccagaggtcaggcctccctgggatcatcgctggttactcactgctctgggcggaggaggtgtgactacaagaatgaagacagaattcaagttttccattctgttcttttgggctctcccttcctctccttcttatttttggaatgtggctgctcagagccttaaaagatccagtcgagctttcttcatggcagaggcagaacccgggtctcacattggaggacagtacattcggtggggaggagggctggtggcccagggccaatccctgttgctggtgagggaacacatccatgcaaacattgccaccctttcaacaaccttctctagatcgtacttttatactgcttccattaacaacttctcatcttagtcttaacaaccttccagacaacatactgccttaaaattttgtttaagtcccactgggggagaatatgccgttggaattactcatccttatttttttatttccaccccactagctatgcatcccctcacagagttataaaaacattagtcttaataaaattgaatattgcaaattagtttattattcctttcctctatgactttctttcagtattcacgataaataaataagggcttagggctgtatcagacccactttcttatgataaaaccttttgggcgggaaaaggtgaagaacaattcctgttcaccagaggttgtactcttgggaaggatctgccaagattatggccataggagtggtgtggcctggaaagattgatcaggatagcaggactctgacaataaagcacccctccccaccccactccactggcacctcacagagccactctgaacctggttgcctcaattttatgtgctaaaccctagggtatttttgcatatcctctttctagcaaatataacaaaagtgacgtccaggaatcagctcacaacagagacagcccaattttagttttgcatcactgtttcattgagtcatgaaaacagatcctgactgagtgacacagttgcatacataactctattgtgcatataaatattgtgtgtttgtgtataaatgtctaaatatgcatggaaaccagaataggctcaaaattttacttgaatgccagatgactggttaaggtcttattaaataagaaaacctcttaagtgcttccatgattactctcaacagcaaattaaagtgtccctatttttggagacttctcccaatgcttatttgtaaacagaaaccctgtgtttgacagagagttctaataataatagcacattgccccctgctgctcactttatgaaaaatatcaatattttgtcacgaagatttttagatttaacatgcttacactatcctttgaaattcatgcctaactcttattaagaccgcatagtaagaatcctattactttcgtcttcaagacttcaacaaaatccagagtttgaatcactccatagcaaatgaagttcttacctagaaaatcagcaaaacttgttgtttgcatcttcccctattcctggctaattcaattgagaatgtgcgtttatgaagatccctgagcctacagtaaaatatatatgttctcaagaaagcatctttagtgctcttcagtctaggccccttccagcctacagttttgcctggtggacttgtatcaaattgcccttagtgattatcttcatctgttccatgggaattccacagactctccatatacacatcatagaggtaagtatgtagcagctgaaagtgtcaggagctctaatgttgagcagccctgtctctagccctgtgcagtctggactgtgagtgccaccatgattccaggaatgctgtccagttctgggacactcttgggggtacaagtcagcctcaataggaatcccctgaaaggactcagctctagatgtgcagggcttgcagtcagagacagccttgctccaaattcccaaggttggaaagctacatttgactttccttctctagagtgcccttcaggaacatatggctatggctgtcgccagatatgtgattgtctgaacaactccacctgcgaccacatcactgggacctgttactgcagccccggatggaagggagcgagatgtgatcaaggtaaatatactagctaatgtttgtagcactgcagtattgtgtgaacaccatgtaccaggcaatgtgaagtattttcacttatgttatccagcagaatcttcaccacaactctaaatggcataattggttacttatttaattgccagatgaatgccttattgttgctgtcctgcagataaagaaacaaaagcttagagaggctgagtaattttcccaaagtcacatagctaatactagaatatgtcacagcttttgtgccagatttttgttattccaaaactcatgaactttctactgggtctatgattttttttcagctttattgaggtgtaattgatacacaaaaaacacacctatttaatgtgtacaatttaataaaatctcgactatctatatacctatgaaaccatcaccataataaatgaaatatccatcaccatgtgtttcctcatgcccctccctacttctaccaccccttaagccccaggtaatcactcatctcttttctgtcagtatagattagttttcattttctagaattttatataaatgaaatcatactgtactcttttgggtctggctttgtttactcagcataattattttgaaatggaaccatgttgtagcacatatcaacaattcagttcttttcattgctgaatactattccattgtatggatatactataatttgtttacctgttcatgtgctgatggacaggtggattgtttccagtttggggctattacagataaagctgctatgaacaagagtgaatccagtttttgcatggacatgtgctttcatttctcttgggtaaatacctaggagtagaataattggggtatatagtagacatatgtttaactttttgtaaaacttgtgcccctggttttcaattggggtgtatgtcataacgacctgggaatagttgtcaggtacatggtcctatttgggaaattccgattccagggttggggactttgagaaagtgcttctgatggttctgaagcatgccctccagagagccacagctcttactgcatgtggtactccctggtaggcaataagcagttgggctataaaaggctttagaaaattgatacactgttgtagatggagtaatcttaaactgcagaccatgtaaatatttacaacatttaatttctttggtaaaatgacttttacatgcttatgatttacatttgactgtcataacaatagaatgtgatctttcattatcacgtcataattacaaatactctgtaatctcactacattatccttggtggtctgtgtttcagggcagattgttttgtaaaaaggtccttcagcatttagaatcataaaatcataggaacatttacttgagctggaagcagtgacatggaggcctcttttctcatttatagatgataaaactgcagcctgaaagcttaagtgaaagttcagaatatctaggtcaatttttttagatgccagatttcttgaatctcaacccatgcctttagcgttatcacttgacggaccataaggaagaactatgtaatgcccaattttgaatttaatgagtaaggtattagggtaatgctatcaggtattatcaggacaaatctttctgtcatggaaaataactttgcacagaacaatatcttctgaggtaaaagacccattgaaattagcaaaaggtagatcctgttcttagactagatttataatggtgttatgcttgcttggaaggaaaattactcttagaaatgctaaggatagacataaaatttggttaagcagttgggacatttagcatttaactctgcataagctcagtattgaataataaataaagcaaaataaaaattagataaattgttaccccaaattaattgccagtctaagtatttaatcggaaatatataagaagctctcaaatcctactgttgaatctctttgggttcagaaaatcctgtctctttctttatatttttttagggacagggtcttgctatgttggccaggctggtctctaactgctaggctagatcagttctcccgcctcagtctcctgagtagctggaactccgggcacgcatcactgtgcccagcttctgtctctttttgaggcttacagcagcctttctctgggcatggataggccgacaacatctgacaatgaggaatgtttgctttttcttcctgctctgtttccaaattaatgttttatgaactgaaaatatgcaggcattagcacagaaggaggtttttgtaagtagagatcaaacgtttatccagcacattgtcatcctttctcaagtctctcttctttttctagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggtaagagcagaggcaggagaggcattttgcttcttgaaaagttaaatttcattcgggttctttaaaactgggtgtttggctgtgctgtccattgtttctgtcaattctcattgagagaattctatgtttggaaaaggtatacattgctagagatgagttttttatttcaacaatagtaaattgtcattctgtggtttgctataagggttttaaaattgagctcattgtgtttgtggtttagatttagggaatttcaatccataaggagctttgtatccagcctcaagcttttgtcatatgtgaggggggtgaggaggaagagaggatgataagtttaccaaggtcatggatcagattagggaccagttctcctgtctctgaatgagggtactttctatgtgcttcccagcctctccctaggcctacccgaatcgttaactgaagggaacaaagttatatcagaaacagctttttggtattagcaagaaccaaggcagccctttaagaaaactcttgattttttctgttctgtcacaatgcctcataaaaggaaaaataaaattataatcaatcatcagtagaagcaaccatttacatggaggaatttaaaagtttaaaatctttattactttttgggtgattattgaaggccttctggttggttacatgtttaaaactacaaaattccgtggaaatatgagaagtagctgatttacatagtagtgcattttcagtgcagaattattgtgtcaagaactcaagtgtttaaaaaaaggaaagttgcagagtagcttcaaatgataccttcccagctgtaccagccccaaagcaaagagcagttatctgtggatactgtgaacaaaagttctctgaaaaggaatttgggggaaagagattttattccagtgaacggtttgcaaacccaggagttgcagccagtgtaaaatgaaagtgcagttcagagaacaaagggaaggcttgggttttatagcaaaagtccccacccagcttccaatcaggcccttttaggaaagtgaaggattgaaactggtttaattctaattgatcagtgcagctgagttctggttggttgacacagcggaaccctgatcctttgataaagctaagccctgattagctaaggcaggtaagctctgattggttggttcagctgagctctgaaagacccaaagataaaaagctgggttttcagggaactcagagtacaggtgtgatccttagtcagcaaaggcctgcttgactcgattttaaatttaggcctaggcagccactcctatggatcttaaataattggttctttcagtttcacatttgttcacaagctttcatacttttccaaggaggcagttaggaaggtagaggcctgttgcttctagaagctttgctgagtaggctgggcaggaggagattctgcccagcttgtgatatggaaggagtccggacatttgttcagttatttatttatttgtttttttatttagagatggagtctcgctctgtcaccagactggagtgcagtggtgcgatctcggctcactgtaacctctacctccggggttcaagcgattcttctgcctcagcctcccgagtagctgggactacaggcgcatgctaccgtgcccggctaattttttttgtacttttagtagagatggggttttactgtgttagccaggatggtctcgatctcctgacctcgtcatctgcccgccttggcctcccaaagtgctgggattacaggcgtgagccacctcgctgggcctgttttgttattttgattcccttttttcacacacatttatgggagcctgctgccttaaccatttccttcccttcttgcaggaacccttcctcacagcaatggtggaaacgctaatagccactacttcaccaatcccagttaccacacgctcacccagtgtgccacatcccctcacgtcaacaacagggacaggatgactgtcacgaaggtgagaggaattggttcaagtctttggaagtgggctggggagagaggaagggaaccagcatttattgagggccgctgttcaccagaggctgttctaggtactttacatatattatctaatttattcctctaaacagtcctctgagtgtgctttgggaatctcaagtttactgatgaaaacctgagtagtagggagtttaagttacttccagacatagctgcccgataatgagtgaggcagctgctgtgtgagtcaaagtctctctgtctctacaatctgtactgtttccattacaccgctttagaaaaacgtttctaattttacatgagattttaaaataatgactcataatgacattaacaaaaacataaagacctatagcagaatcagccgtgggcaaaatctccaagtgtgtctcttctgaccgcccgtcctccagtacccgttcctggccacctgtgctttagtaacaacaacagtaataggcactgatttgggttgaaccacatgaaattgctatttttgtaggtcaacagtggtcacatagcaacaacctaatattatgtgccaagcatttctaatcacttaaaaatataaactcatttaatcttcacaccagtcctataaatcaagagtgattattatgccgattttacagatgaggaaactgagtcacagagaggttggagacagagtgtctagaacccagagctgctactccaatagcacccaactcaccccaggtcttccccacaatgctctgaagtctcaaacatttctttcttccagtcatacccaaattatatttctaatctctgttgtctaattccagtgctctattagaaaaaaaatcaagctaattaagttaatccagttgtaatttaattaatgcagctatagattttaattatagtgcttcatggttaaatatcactccacataccccagagactttcacattcatcaatttattctcatacaaattcagggaaggaggcaaagcagataatcttatcctcatgtttacgcctaggataactgctaagagtcacctgtgattcacacaaacatacaatttttgatggaagaacttagaccaagagttctttttttttttttttttccaaatcaaagttacatgtgtataaatccaaataaggtctaattggcacaggatgacagagtgaaatgaagatcttgaggtggtggagggagtagctaggactgaaggacatgaactcctgccagcttgcaagtcccaccaggttacaagcagtcacctcggcccctgagctcaggtcactctaaggactggtcctcaatatgtgccctggacttttccccaggtccataacgctgtgctgtgccgcattgtattttgtttttaatctttcgttgtttatatttttaacagtcaaaaaacaatcaactgtttgtgaatcttaaaaatgtgaaccctgggaagagaggccctgtgggggactgcactgggacattgccggctgactggaaacatggcggctacctcaacgagctcggtgagttctcccaacgcacgtccccagaagcaccttgacctgtcagtccctgaaacagtcacggatctctgtttgtgccaaggtgttctattgaaaacttgcatcaaaaagcacaatagcagaattatgcctaacacctgtacagggctatctactgtcctaagggctttatctattcaacaaacatttattgagttcctactatgtgccaggaattgatcaaaagagattgggatctctgcctgctcgtagcttacattcttgctctatgcctgttaacttaattctcacaagtactctaataggtgggtactattgttatcaccatctgcatgttacagttgagaaactgagtcataacaaggttatgttacttgcacaggacctcatcgcctgttaaatgttagagctagtattggaccctgtcagcttggctcacagctgtgtgctcttccttgttctcttttgatatagggtatctgtacttgagatccccttccctttcaggtgaggaatcagagataccaacaggaatacagtggatcagtggttcgggcaactttttgaaattaggactcctttgcattcttaaaatttattgaggacccaaaagagcttctgttgataggggctatatctatttatatttaccatactaaatgaaatttaatatgtaaataaaaactggaaaaaatagaatgttaatttatttaaattaataataatcacatttcatggtaacataaattgtgtttttattaaaaaaaactacattttccaaaacccttcaaaattagcgagaagagcaatgctattttacatttttataaaaaaatctctttaatgtccagcttaatagaagatagctggattatcatgtctgcttttacgttcagttggttttgatctcatactttatgtagcttctgaaaaactccactgtacacttgaaagagaattagagtgaaaacggcaaatattgttgttgtattgttatggaaatagttttgcagctgggcacaatggcacaggcctatagccccagctacttgggagcctgaggcaggaggattgcttgagcccaggagtttgagtctgatctggatgacatagcgagactcacctcttaaaatatatatgtgtatatatagttttgatctcataggcctcctgaaaagggggcaggaatgcttggtccatacttaaagaacttctgtgatataccattaattatgcagtgcagtttccaagcctgtaacccatattttcagacaggagtttgatgatgtagtaacttacaggtgtgcagtgtcttacggatagcaaatcctttcacgtacatttatttggaggtaggtgccagaaatcccagttaaatttgaatttcagatagataagcaacacatttttttgtataaacatatcacagatattacatgggatgtacactaaagattattttttgtttcttttaaattttaatataactgacctttgtgtattttcatttgctaatgttttgttttgttttgttttgtttttgtttttgtttttgagacagagtctcgctctgtcgtctaggctgtagtgcagtggcgcgatctcggctcactgcaagatctgccttctggattcaagtgattctcctgccttagcctcccaagcagctgggattacagatgtgcaccaccatgcctggctgatttttgcattttcagtagagacagggtttctccatgttggccaggctggtctcaaactcctgacctcaagtgatcttcttgcctcagcctcccaaagtgctgggattacaggcatgagccaccacacttggcccatttgctaaattggatgatcctcctgggtggactctctcctgtgaatcttgttttgtagaggagtagactgggaggcacagagaggttaaccctcttgtctgaaatttcaaagaaggaaaggggtaaagccagatttcaaagttgatcttctgactgctccccttaaacactgcttctcctgtaagcagtgtcaagttctctgagccagtcataggaactgatccctgtgggaatgcctctttctatggaaataaaaatgttttactggtgaatacaaattcttagtcatttccatagtgtagtcgttatcacgctcgctgtacaaattcctaacttttatctgtattctataccatttttatcaataggatgagtatttctaaccacagtaaaattatttacatacgagactcacaatatgcttattggtaacatcatctaacattaaaggagactttttaggagtcttaattacatttataatttagctcaaaggaatatatgaattgatattcagcaaaataccaaccagcgctagtgaaagaaaagtcatcttgttctatcttagaccactgtgaagactccagaagatacggcatcactgtactggtcacatgtaaatgtctctgctttctggctcaatgagacccaagggactgagtgttaggaacctaggatcttcattggaaattctggatcttcttggtttgttctcactcaggaataattctgcatttaacatccctttaaagttgttgcacagaaaaagttcttcacaaaggacagagtcaggcatgttatggatgataaagcttacaggtgctttaaatgatggaatagttgtcgtcatggtatctgaaagagccttgaactagacacaaaagaccctgagatatagcactgggccagtcacttaccctcacttacccttgattcgttcatttgtgaaatgggagtaataagcatgtactggctcgttttgtgaattaaattaaaccaagcatttgaaagccctgctccagggatgggtgtatataggagtttatagggaatcctgactgctccctcattaaaacagctccctgatcctccaaggcaatgaagacagaatctggcaggggtgtctggcctcatagccccagctcttattccctaacttactatctgctccatgctggttctctctttcacaccttggtggaaggctagccactgcacagctaagattaaaatgggcatttaataagactttgctacagtctggagatggccaagagtatttggcaaagaggagcatagacagagctccttgataaagctgttctcagaggccacagactgtgccccatcttcatgggtcctctttataaagtctgggaattcccaagaccaccctgacttctgacatcagctacaagttgaaagatcaccaagacgaccctcaggatcaacattttgctacaaggagtcactgaactcactgaatgggcattctcatggttacagtttatggggggctcagtcatatagacatgattgactcccatcatgtagacatgattgacctttagtctttccccttccagaggtggagatgataccatatggcccaaaccccccaccataaatcacttggttacactatccggtgtatccctgggcctccgggtgaacaaaagcactcctattgggcaggacagtccaaggacttcaagatcacctcccaggagctgagggcaaaggccacccctttctttgataaggttaattcttcactacacacccatttatgctgcctccctgcataaccgtgtgcccttccccccagctatgggcttggttagactcttcacaacccagatgcaagagagtgtgcctgagagaggaaaatattcccatttcctgtcccacgatgattgatatctgacagaccctctccctttaggagaggctgcttccttctccacaacagtgtgtgcttactcagtgatccccatgggacaccaacatcagaacttgagcttaacatctctctaagagatgcatgcacagtggcaaggatatcgtttccttaacattctcaaatacttacctggaatgttcattgctagttgttactttactctctgcttttaacctaagtctgtaacattcttattgtattgtatttcaaaagattagtgatgaagttttgccatattgcccaggctggtcttgaactcctgggctcaagcaatccacccaccttggcctcccaaagtcctgggattacaggcatgagccaccgcacccggcctgtaatattcttttgaaaggcaattgaaaatgccttggagtgcttaaggaaagactgaagcagagggtagtataatgcactgagcgttagagtaattgacacacttcatttgtatggtgcttcagagtttacaaagccttttcatatgctctgtttcacttaatgatgacaaaaaccctggaaggctggaaggcaaattttgttttccccattttagagatgagaaaattgacactcagagggtggaacatcttgcccaaagtcctatggccaataagttataacatgtaattcctttgtctcctaatctatagttttctccttttttgtcacaacacagctccaatagaataattgactcccatgcagtattaacaatgcaattttgcacgtatacaccagatagtataaaatgggctaggtaatgtcgtcttattttgtttttagtagtgcgaatttgtgattaaatgcttatattttatacaacatgcttgtgacctgattgatttctgtaagtggttgcacgttctcttgcctacatgctcaatttttccagcatgagccggaacactcctatttccctccccacacccacgaaataaaggctggccattttccaatgagaaagcaggtttttttgtgtgtatctaggctcatacacaattatgtccccatacctggaaaagtcaaattatgaaaagctgaataaagaagggcaagagctagtatcacctgtaaagtattagtcaacagtgttcgaagcttccagtctccagaaaacatgcttatagtgaagacaataatataaccgaataatgattattgggaaaactatttgaaaaccatcagagccttgaaagagctgcacgtaggtatgaaatgtcaactctggtcttggctgtatcctttcttttcactgtgcaaccttgaatcaagtatactgatttatctctgggcctcagtttctatcctgttttgactagcttttcctgagtcactgtaaatgactaggtgaatgaccaaatgtgtgtgtgtttaattctaggcactggggacatctgggacaactgatctggtgtaaaggcttgaagagcagcagcctggttgtttgctgcagtgggagatcctcttccaggaccttgggatattggatggggtttttcttcctttcagttctcactgggtgttttttttcttcctttattacaggtgcttttggacttgacagaagctatatgggaaaatccttaaaaggtatcatgtaaatttgaagaagaaatcagaagcacaattaaattttttttaacctcaaagactgaaatagtttttaaacaagctagaatggcaagagaaaatgtagaatttttagtgtggtcagttactacagcaaacacacaaacatgtgtgactgacatcaagaaagtgaccagaggtggtccttggtagagcttaagtctttggggaacaaaagattcagtttgctgaggaaacactcatatttcatttaaaagaaatatggcttatggggagacggaaacatataaagggaaatagccgggacaataagaaaagatccacatggttacatgttgaccaagttctgctgttcaggatgggtgtgcatgattagatgcctagtacagagcttttactaggagtcctcccagcacaaatgccttcttgtcatgataatagagccctcttggtgctcctggggccatcaacagctggtttcttgattgaacttctgtaaattttctattaataaaacaaaacgtaattgattatattctaatgtgatcataaaaatgaaatcagttaatgatattgatgtcagtactcatcttggagaggagctaaaactactttagggatgggtcattttatagcagattctctccaaaacaagtggaaaaggtacagtattattttcagtgtgtagaattatggaaacctagctataaagaaaaacagtaaaatatcaccaagaaatgatgttgccagtgacacagcattagctttctcttctcatttctcttcacagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttggtgagttcccttaaccatagaaagaaccgagtgcttaagtttttaaaaacaattttaaagtctttacgaatataatagttgcaggtcatagaaatcttattgaaaataatggtccgtattttattttattttattttattttatgtattttttgagatggggtctctctgtcacccaggtggtgtgcagtggcacagtcttggctcactgcaacctctacctcccgggctcaagccatcctcccacttcagcctcccaagtagctgggaccacaggcacgcactaccacgcccagctaattttttgtattttgggtagagacggggttttgtcaccatattttattaatagatgcgacctgtgtttttagcgatcatattaattggtgccaaaggaattttccagggaaaatattatttagaaaaatttaaggtaaagtttctttatttttcacctaatcatccatcttttgttttgtaaccatagtgaatattttggcacacatgtggatagcatatgtatcatattagctaatatatctacttagccgaaacaaatggttcaagtggattaaacaggtgattccatttcctggttcattatattaatataatgcatttagcaagattgaaacattttacttttaaacttgtccaaaagagcagtaatattctctgatgtgaatgtgatgcaaattaatatgaattcaatttaaaattggagttattttgattgtcttttgcagataccacttgggaaatgataaaacattccaccactactcttggctaaacaatagggctatatattttcatttctctctctctctctgtctctatttctatgtctctctgagtatttatgattttaactttaaaatattctctactacttgtaaatgaagtgcctactttactactagtaatttattttatgccagatacatccctgggaaaaaatatacaaaataatttatttttaaagtattaagacagctttttaaaatgcaagtcaaagtgaactaaatttatttttggaaagtcagtaacaattctcctttaaactgtcccacaaacctgccacagtaggatgggaactcaaatgagagcctgagtcttgagtcctaaagttctgaacatgttgagtgttttcatgaactgaattaacgtttgagaatgtcagtcttctcacctgtggaataaggggcttggcctaccttatccccaaggtgtttttcagaccatgatttatttccaggattctgtatattcccttaatatcttcatcccgattatgtggtcctccttttgttctgaacaccatttgtgtttgccagttgatccaactacacagagttgccacctgtatgtgatgatttttaaaatcatgtttttaaaaccagcatttccttatatttttttaaaagtccctttggtgtgtttgacatttgcaagaaatgccatattctttttaaaaacatttcctttgctgataaattaatatgtccttggttatcacagaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataa

SEQ ID NO: 2183 - DNA, 170456 bp, Homo sapiens; identical to SEQ ID NO: 2182

SEQ ID NO: 2184 - DNA, 23037 bp, Homo sapiens
cgagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtgtaagccctgctttccttaacccttctccccctcagttccaggggtcacgggaggcctatctggcggtgaggactaagagggtacgagggtcgggggctaaagagctaggcatccagacgaggggtgcgtttagatctcgcgatcagcgatatgaaaagctggggacgcgaaggataaaattggaccattgcagctagtgatgagagaagcattggtcacctgatcctgaaaagccctaagtctctggtgggggcggaaaagcccggctgaagtgaattcaagagtttgggggcagttcaggagattggggggcgtcaggatttggacatcgcgaggagaaatcaccttctttctgcgctgtagtcaattttatctcgtgaatgtcagcacattggtgttcttattagcacttaccttgagtaccttttatatttttaatttaagaccttctggttgcacttttttatttattttaattttagtggactcttgtaaatagcctatatgtatatttactattcagttcaacattttgttaattaacttgagttagtccagttatacttatcgtgattattaatattttccattgaattttaccgtcttattttgtggtgtgtcctttcctatgcacatattttaacactggaaaataggacatacatgcaaaaaaagtatgattacacacacacgcagacttacacacacttaaaaggacaacagtaaagcgaatttacaaaccaggccaagaaagagattattaaatctcagaaagctgtgtgcctcttctaaactgcatcctcctctcccaccaatactgtctccgtggatttgactgcgtatacatcttttccagaaaatatatttcctaaattttggtaattatttgtgaatgaactcaggcgcttcagtatttttggaaacaatctttttctgtattgattcaagcacacctttgtaatttagagatttctaaatatcttgtagatgaagtacttacacctagccattctttttcaggaatgtcatggcttaaattctagtcagttcaccaaattccacatactggacttttgttttcaagttgtggtgaatctatatttgaactttgggaatattgtcgtttttatgccattgagttgcagttaattgatttacatcatttatttacatcttctttaatgcctttcaataaagtgttttttgttgttgttgttgttttttcctttttgagatggagtctcacccttgtagcccagactggagtgcaatgacaatctcggctcactgcaacctctgtctccctggttcaagcggttctcctgcctcagcctcccgagtagctgggaatacaggcacccaccaccacacccagctaaattttgtatttttagtggagatggggtttcaacatgttggccaggctggtctcgatctcctgacctcaggtgatccaccggccttggcctcccaaagtgctgggattgcaggagagagccacgatgtccggctcagtaaagttttataagtacctgcaaaaaggatttaggttgtttttgttatatttattcttgggaactttgttttttggtgctcagaaaagtctaacttttgtgtagtttgttggatgttcttcgtagacaaggaaaatgtgtacaattcaaaaggaaaatacaaatatttattttatacagacgataaattgtcttttttgtttgtttgtttgtttgtttgttttttgtgctggactgggtggggacttcccttgtcattgactggagtttggatggcacactctaggcaagcctgtttgttttctgatcttaaagggaattgtcatttgtgtctgccgaaggcttttctgtcgaatagtttttattaggtcaaggaagctcccctcttttcctacttgagtttttcttgtgaattgctgcaggcttttaacaagtgattttttttttttttttgccattatgtatctgtttattgatacattttgtatctgtttgatacaaaatctatattgatagttttgtatctgtttattgatacatttctagtaccttaaattatggcactcagtactgctgtgtaacaaattaatgagtgaataatataattttttttctatcctgtagtgtggcaaattaaaccaattgattttctcttgttacattgaatttgtattggtaaataatttggaaaggacatgttactatttgttacttttggcttcggtttgctaatactttgtttggtgtttttggatctatgcttgagtgaaatgttccttttctgtttcagatttatgccagcctcataaaatgggatgagaagtgttctgttttctaaactctggaatgttttgcataagaatagaatattttgttccttagaacgggagtggtacctggaaaaaccatttgggtctggagttttctttgtggaaagttttaaagctattgtttctgttcttttaaggtttgtggggcattcaggttttctgtgttgttatgatgagtaaaatttctttaggaatttatttattccatctgaggtttaaatcgtatagtcagggttgttcataacatactcaaatttttaatgcttgctgcatttgtaatgttatccacttttttatttataataattatatgttgctttttacaaaaataaattccatcagaatgttgtcagttttcttcttaaagaacttctggcttgattgaaccactttatgatatatatgttttctattttataactttctgattgttatcattttcttcctttttgggatgtttctttccagtttcttatgttgaatgcctgtcacatcccaaagaattgcagtatcatactttattgtattttaattataaatatcaaatatcatggcttctttggcatgcagatttagaatttttttcttttaattttcatttctgtgactttttttctggttatcttttggtcattgtttgccaactgcattgctctgtggtcaagcattttctgagacaaacatggccccatgagtgctgtctcatcatgttcaatctgcacatagttattgaactgcctgcttaaactggatttgtgagagctctggtggtggcttcatccatttctccttagaattctgtccccccttttttttttttaatttttgtgttttccttttttttgaggctgtgttttatacacacaggcacacacacacacctctttttggatttataactttttattatgtaatacttcatttttctctatgagcctttttgccttaatctattctgtctgatactaacattcaaaccagctttctttttttttttttttacttgccttatatatccttttatttccattcttattgtactcttttttctttctttctttctttctttctttcttttttttgagacggagtttcactctttttgcccaggctggagtgcaatggcgcgatcttggctcactgcaacctccacctcctggaatcaagtgattctcctgtctcagcctcccaagtagctggaagtacaggcgcatggcaccacacccagctaatttttttattttcagtagagatggggtttcatcatattggtcaggctggtctcgaactcccaacctcaggtgatccacctgccttggcctcccaaagcattgggattacaggcatgagccaccgcgcccggctcttattgtattcttatattttagatatctcttgtacgtagcatataattggattaatctattctgtgaatattagtattttagttaaagcatttattctgttagcatcttctgtattaatatatttgaatgttacatttgtcttctgttttttctctagcttcttttgtgtatttttgtcattctccttttttattttctgtacattttgaatttatttactctattatttcagtggttgttctaaataattcttacccatgctcattcactaaatctagatttgcatatgttactctcctgatttacatggttttcttatgcattttcattctttctttattgatatatcatagttgcacatattgagttctttttttaaacctcagaagaaattattattgctattgcataccatcatttcttgtttcattatactcacatgtttatcactttgagcactttacttggttcttacactttttggtgtaattcttccactgtttgctttggttctttaattacttctttctccctgaggtatgtctttgatgatgtctcttttctgtgggttgcaagcccacaggaactttgttttttggtgctcagaaaacacctctttctctctttctcagtggacatttttggtggtaatagaattttatatttcagaactatgaagatgttccattatcttctggcttccactgttaatgatgagaagtcagctgtcagtctaatgtttgtttgtttgttttctgagacagagtctcactcttgttgcccaggctggagtgcaatggcgtaatctcgtctcactgcaacttctgcctcctgggttccagcaattctcctgcctcagcctactgagtcgctgggattacaggcatgggccatgacacccagctaatttttgtatttttagtaaagacaaggtttcaccatgttggccaggcagcggttttaggagcctagaaatgtgagtttttcgttttgttttgttttgagacagggtcttggtatgttgcccaggctggtctcgaactcctgcgtgcaagtgatccacctgccttggcctcccagcatgctgggattacaggtgtgggccaccatgcccaggcttactttgtttcttaatggagagatatttacggtgtgttttaacaagacctccaggtgactcccatgtaacttaaagtttgagaactattgcttaaaaggtaacctgtctttttctcctctggctgctgttcagatattctttttaccgttggtattatctggttcattgtgcttaagattttatctctcttcaatctgtttatattttccttcaaaatgaaaaatctacagccactatattttgcagtgattgcctaggctccttctctgtctctcatcagtaactccagttagaaatggttcaattccttatcttctgcccccacgtggttcttagctgtatttatgttcctcaactctttttctgtgcttcccttgcatttattgctacaactggctttgaaacttcagccttcataaaaatttcatgtagagtttattaaaatactgattcatcagcccaccccaaagagaattgaactgagatatgatctgggtgtcagagttacttaaagtgttccaggggacgcttatgcagcagactatatttaagaaacaaattattattattattattattattggctgtgtataatctaaaagctatttacttagggcttttgttgtgggtttccattttgctttttttttagcaattgtaattgccctttagaaatcataaatttttaattttctgaatgttaatttcttgccagcacatgaatttgaaacctatcatctgtctgtactttgtgttgcatttgaaatagttatgcatggaaggtttaattggggcacctaggttgcttgttggaaacagaattcctaccctgctccccaccccctgggacatctcatctagctggttgaaaggagggtatattgatttactaatgtaatgcatttctggaccaagaaaatggcatatgatgttctcacaacctttgttgccttctctgtctctcgctatatatatattgtatatattatttatatactttttttcttttttttttttttgaggcagtgtctcatttctgtcacccaggctggaagtgcagtggcatgatcttggcttactgcaacctccgcctctcaggttcaagcaatcttcccacctcagcctcccaagtaactgggactacaggcatgtgccaccatgcctggctaatttttttgtatttttagtagaaacggggtttcaccatgttggccaggccagtcttgaactcctgacttcaaatgatctgcccgcctcagcctcccaaagtgctgagattacaggcatgagccaccatgctgggcctatatttacgtgaataacagtggtagaaatggttctagcaagggcagaaataccagtcagtaaaagtaacaaaataattattctctctacagtatttacatctgcaaattctgaatatcctgggatactgtgattaagttgaatatggggataaaatcaaatattgggagaattatggtcctgagaaagctcataatggaacagttttgggcaacatttgttttggaccacaaacttgatggaggaggcagatcttctaaaactgaggagcagggctggagcaagggtgaggtttgtgagtgcagagccagggagccactcgctctgagccaaccttgtgcttgtctgacaccagaagtgcttccttaaataccacactcttgtctagcagccttggttgcctcatcccagtcctggccctggtgaggagaaaaacagatcccaatgagaatagagtaagatgtgtagaaatagaaaaatagaactgctttcaccatgctgtaaagaaaattaaaagagaaattaagcaaccccaacagctctgaaaaattaacctgtccgttctaactcatccatggtgacagcattccaatgacactggtttttttttttttttttttttttttttgagatggagtctcgctctgtcgcccaggctggagtgcagtggcacagtctcagctcactgcaagctctgcctcctgggtttcacaccattctcctgcctcagcctcctgagtagctgggactacaggcgcccgccaccgcgcccggctaattttttgtatttttagtagagatggggtttcaccattcacaggatggtctcaatctcctgacctcatgatccgcctgcctcagcctcccaaagtgctgggattacaggcgtgagccaccacgcccggctgatcctggttttgtttcatgtatcatgtagaaacggggcagaacgtctctgagttcatagatcctacagctgttctagacaccctgctccacatcctgctggggtcgcttagatgctgaaatcttcctgctttatttgtattcatggccaccagttctttgagactctctgatacagtttggatgtgtatccgccccctccccccctccaaatctcatatggaaatgtaattcccaatattggaggtggggcctggtggggggcgattggatcaggggggcagatttctcatgaatggcttagcaccatcccccttggcactgtcctcgtgatggcgggtgagttctcctgagatccggtcatttacacgtgtgtggcacctcctcccaaccctgctgtcttgctcctgcttcaccatatgctttgcctgcttcccttttgccttctgctatgattggaagcttcctgaggcctccccagaagcagatagcactgtgcttcctgtagagcctacagaactgtgagccaattaaacctcttttcttataaattacccagtctcaggtatttctttatagcagtgcgagaatggactaatacaccatcacccagcactgacaacccctgaaagtgatagaatcactcaggtgagaacttggccagaagctccactctgagctctggtttgcatcgttgcaaaacatcgacaaggttccacagactgaattgatgtgggtgcgctctctaagctccagccctctggacactttgtccttcatggagggtggtggtggatgttggccccagggtgttgggctaagccatagggctgtgtcctagtacctggattactgtttaatttcacaggaccttctgaggagatcccagaccccctacattccataggcccctcctttatggtctcccaaggtctgggtggctgtctcagtatgaaggcaaatgtagatcagcttgctcatcatccattcattctttcattccctacttattgtcttatttatatcaggcactggaatggtgaatgaaatatcatcaaagtaaaaagtctctactcacctggaatgtattttctagttgggcatacaggaaatcaaaacaagtaaactacatagtgtgcatggaggagacagcagagagataataatgcttacccggtgttctgtgtcctgtcctacatttcccaggatccttggagctggcaggggcatgtgactagttctggccaatgggctgcaagtgcttcagggtcaaaatatagacgacagaatgcatagttgtccagcttcctgctcatcatctatgaccaacatggccaagggtatcagttggttcagagacaagtggcatccttgaacaacaggaaaacttttgacatcagcctgggttgaacaagtgacatgagcaaggcgtaaactttccattttattgagtcattgagatttgggtttgtctgtttttgcagtaaaaaatagagcctaatcttacacagaacattacttggaaattagtgctttagggaaaaagaaaaggagtggagaattgggattgaaagaagcaggggtttgcattttaaaaagtggccaaggcgggtggatcagctgaggtcaggagctcaggaccagcctggccaacatggtgaaaccctgtctctactaaaagtacaaaaattagccggacacagtggcacacctatagtcccagctacttgggagcctgaggcgggagaatcacttgaacccgggaggcgcaggttgcagtgagctgagatcacactactgcactccagcctgggtgacagagcgagactccatctcaaaagaaaagaaaagagtggccagtgaatgccagatcaggacaggtaaagttgaataaagatctgaaggatgagagggggccaggcacactgagaatgtgggggaaacatttcaagcagaggagcagcaggtgcacagaccctgaggtgggagcatggctggcggggcctgatgcacagcagtgaggcttctgtggcttgggtgagggaccagtggcagagcgagttgtgggtgaggcggcagggacctgggcccttggtctgagtgagatgggacaccatcagaggatcttgaacagaggagcggtgtgatcttcattttacccataaagttacggctgtcatggaagctaagggaagtcagggacagcagctgggagaccagttaggaagcagttggaatgttctagaagagaagcgatgccttatgccaaggcagtagcagtgtaggtggtgagaagcaaccagatttttgtattaagttttaaagttaaggctggcaggatttgctggtgatgcaggtgtggtttatggaaaagaaagaggagagttgaaggtgatgacgagcaaggcttttgacttgagcccctgggaggctggagctgccatcaacgtggggaggctggtggcagcacagttgtaggtgtttaatgtgggatcctgttggctgttgcagtagggatactaagtagccacctggctgccactcactctgagtcattctgggtggggcaggtgccagggagcggagagtggcacccactataaatgaacaattctgttaagtaattgtgaaatcgtcagtggtcattttattttaatgataatggcattttagagtgaatgtttgtttactgagcctatagagttccatacataacccagtgttaaagtcttcagtttccagatgagaaaactgagttttgatgaactgactcttgggaggggaatgagcagaactgtgggcttgcattaaaggggagtctactgaggcctcagggacagggagaccttcacagaagtgcaatcagaacctgggtgtcagcacctccaaatggtgggggtgtttcacaatgtggacctgtgggagatgggggagaggggcccaggggaaccctgacctttaggggctgggcagaggagggatctcaagccagagtcttcaaaagagcaaccagagatgtgagcacagactgggatgagtgggctatggctgcaagagcagtggcattcccaggaagagggagatagattcatagtgagcaagatgatgtgtcaggaggtcaggcaaaggaagggtcaagatgtagtgtcaaggagttcccacataggggacagtacaggtgacataggtcactttgagaggcaacaagatgtggctccgcagtcacgtcagctgggctcacaacttccacctatgaccttgaccaagtgtctcggacccttggtgccttattctctgggtacttgagaataattccgggaggttgtgaggattaaataggagtggccctggaaagactcaggagaatgtctcataccttgtaaacactacacatgtcgttatttgtagaattggcattaatgttggtggggaaaggtggaatgggacctgcagaagcttgttagttgagcatgaatgaatgaatggtaggtgaggatggagatactgtgcctcaggaactgagcctctgtcaccctctctccccttcctcagcagtgacttaatgtcagaacccaaaggcacaatgactagaaaagggctttgtaaaaagaatgaaagcgtcatgcatctttgagttggcccaagatcaaatttggtgttgaataatgaatccccaaggcagagtttatacgttaaaacacacttcctatattattgttttgaaatgtttctgaatatctaaaacaattccaatagcagaaatactaattgatgttgaaaaagattgttataaccctggtaatgtttaaaagtggtaatattgattattgatctgagtcagatgttaaagtagcagcgtcacggttcttacatcagtgctgtcatgagagtcgcggtggaagccagagagaggaggcatgttcatacaaagcaaattaaatcccctcccgaggtgtgggccaccatacctcaccaatgtattgtggttttgatgttatttccttaatgactgatgttgttaatcatcttttcatgtgtttacagttcatttctgtaaatttggagaaatgtctgttctgttcaagtctcctgcccacttttttactgggttgtctttgttgttgagtttataatgatattaaatccctatcacatacatgatttgcaaatattttccaccattctgtgtctcattcactttcttgataatgtccttgatgttaattctaaatgtttggtagggttcaccagtgaagccccttggtcctggactttttttttttttttttgagacggagtcttgctctgtcgcccaggctggagtgcagtggcgcaatctcggctcactgcaagctccgcctcccaggttcacaccattctcctgcctcagcctcccgagtagctgggactacaggcactcatcaccacgcctggctaattttttgtatttttagtagagatggggttttaccgtgttagccaggatggtctcgatctcctgacctcctgatccacccgcctcggcctcccaaaatgctgggattacaggcgtgagccaccgtgcccagctggtcctggactttttatttaatggcttttgatgactgcctcagtctcttgttataggtctctcaattttctttttcttctagagcctgtttgggtatgtttcaaggaatttgatacatctagagcattgatccccaagccctgggccacagacaggtaccggtccctggccttttaggaacaaggccctgccgcaggaggtgagcggagggcaagtgagtgaagcttcatctgtatttacagcggctccccatcactcacattacccctgaactccacctcctgtcagatcatcagcagcattagattctcataggggcgcagaccctattgtgcactgcacatgcaagggatctagattgcacactccttatgaaaatctaatgcctgatgatctgtcagtgtctcccatcacctccagatgggaccatctagtttcaggaaaacactctcagggcttccactaattctatattatggtgagttgtataattattttaccatatattacaatgtaataataatagaaataaagtgcacaataaatgtaatgcactcaagtcatcccaaaaccatcccccctcacctcaccatccatggaaaaattgtcttccatgacaccagtctctgatgccaaattgggtggggactgctagtgtagatgatctaatgtgttggtgcataattgttcatggcattctcttacagccctttgaatttccgtaaggtcggtagtaatgtcccacttccactgatgattttagttacttgcatctttttttgttagtaattctagctgtagttttgtcacctttgttgatctttttgaaagaaccaacttttgttttcattaattctcctattctctatttcatttgtctctgctttaatctttatttcttcacttttgctttccctaggtttagtgtgtcaaggtagttgtttttgtttgtttgtttgtttgtttgtttgtttgagactgagtctcgctctctcacccaggctagagtgtgatggcacgatctcagcttacctcaacctccgcctcccgggttcaagcgattctcctgcctcagcctcccgagtagctgggattacaggcatgcaccaccatgcccagctaattctttgtatttttagtagagacggggtttctccatgttggtcaggctggtctcgaactctcgacctcaggtgatccacccaccttggtctcccaaagtgctgggattacaggtgggagccactgcacctggctggaactggtttttgtatgagatgtcttactggtggcttttcctaggcaaagggaataagatctcgagttcctactggaacctaagtgttagagatggggattcaggttaaatgagtggatgtgattacctgggcaaagcatgaggcatgcgaaggaatgggtaaagaatggctcttgagcagaatcagcctttagtggtgaaagaggacctctggatggtccagatgatccagagaagcagggaaagaaccaggagacagttgtagaggagccgagaatagagaatgattctcaaagaaaatagacaccacattttcgtgagactctaagactgaagtgcatttactggattcactgacacgggagtaaattgtattttctgtgaggatggggatgatggtagtggatgctgggtgtactgaattgggagatggtgaatgtagactgctcctaagtttttgctcggaagggggcactaaggggagccagggcaggcattggtttcaagatgggatagacctgagcatgtgtccatgcataggaaattgtctagcagggcgagaaatgaggctgaaagtaaaggagagccaggtagtgcgagggtccagagacggggatgggcctggagcagatttgaaaggattgccttgagaagggagggcagacatctctttgtcatagaaggaaaggaggaggtcatagatcagttgtgagaagactgtttaaataactagaagcaagaaggtaagaaagcctcattttttttctttcttttaagcagggtttaatatatgttcaagaaaatgcataggtcttacttaggtgatcagtttgaatttttgacaattgtgtacactgtacatctgaaaataggtaagtttctatcatcctagaaagttccctttgcttctttcagtctatccctgtcttatcctccattgaagaaacccccttttttttttcaattctatcaacttaattacgttttgcctattcatggacattatattgttggaatcagagcgtttcttgtgtgtccagtttcttttggccagcatcgtagggatttctccatgtagtgtgtctgcatagtttctttttattgctgagtagtattccattctgtaaacattgcaatttgtatatccattctctggttgatagatgtttagattgtttacagtatttggctattaggaatcagactactacagacatttttgtacgagtctttgtggatataaattgtttacagtttctcttatataaatatctaggagcagaattgttggatcagatagtcagtgtgcttgttaaaaactgccaaagtgttttccaaagtagttgaactatttcacactcctaccatcaggatatgagaggtgccagtgtgccccaaactcagcagcatttagtattggtagtcttttttattttggctgttctagttttaatttgcatttctctaatgactatgatattcaacaccattcgatgtgattcttactggttttgtgaaatgtctgtttattaattaaagtcttttaccctttttgttgggttgattttctttctttctttctgttttgaaggagttctttttattttttccaataagccttttgcactcctatctaggagttctttaatctgaatacgaattctttttcaggtgtatgcattgcagatatttttttcccaatccgtggttcactgttcattttccttttttctttttctttttttgtttttagagacagaatcttactctattgcccaggctggagtgcatgatggtagctcactgcagctgttctctatgaatttttaagtttctgattcatctcaaaagatgtttaaattcaaattcagtgagtggaggaggtggcagaagcataggtggccgcgaatctctaaagtgagagttgatgtgagaaggttgcacaggagactttgcccagagagcagatttccaaatcattgcctgtgaggtgaggctgattctagtgatgatgcagtccaggccatggcccaagggtgtatatgttggtgtggagtgtgggtgcaaagggcattggagtttggaactcatggttgatcctgggtggaccatcttcatggatagagccatcctaaatgatcgcaggcctcgaaggtgaaggaagagcagaagtctaggaccagagtgtttaatgagtgagggggtttaacagagttgtacttggtggaaaatcacttaggaagagtaattctgaacccacttatagcagatcaggggctgtccccccaccacatcaccacattgctgagagagtttacctaagtaagataaaagtccaggatcaggcagatcttgctgctcaaaagaggaaatgccaaaaaacaaaactcagagttttctttggtgagcaggagagacagatagcctttcactactcccgatgttctttcatttgctacagatgccagcttggagagtcacgtgagagcaagagagtagctttctggttgtcctggtgccctgctcaggcaaactgactgccattctctgaggatggcagctctgtcccccacatttggtaagttcttgggtcagtgcgtgccctgagaaagtgagtgcaagtggcccctgccacttgatggggtgaaagatacgtacaccatagagggctgctgggagaggatgggcaagtggaaaaggggtgggaacagagccccagcagccaccccagtgactgtgtctgctgagggtcttggtgggtctgggagcaggccagtgtccttatcattcatgcatgaagagggtgcaggtaatgggtaaccctgagttatctcatttattattttgatcactttcagcaaggtcacaactctagctctcagaacttgcatttcttcactcctaggttggaactatgtcacttcttatgagtatgtagcccaccaccctctttatgtttttggtggaacagggctgctctgacttgttatgaaactgatgtgtgcaagagaggtggggggaggaagagagagagaggattgaggatgtgaacactcagaatcagtgtggagcagtttcctggtttacaagtgttgtattatgagacagggcaggctctgattctcatgaaccctgttttctcctccagccacgtccacccaggattccacctgtctccaggactcagaatttcctgtttcttcaaaagaccattcctgtccccagaatttggacctgttcgtgtgcagtggtctggagcctcacacacccagtgttggttcccaggtgcactaagatctctgggtccctagagcaggagaggcacttcctggaagaccccaccagtgcatgctggaattcttgcagagcttcatctcagccagtggatgccagaacagggcccaagagagagccaaggaatattggggctgtcctggtgttggggaagttaggggaagtgatttatgtagcatctgtttccctcatgcttgcaaaatctcaggcccttgctcagccccagagacggggggaaataaagggcaaagctctcggagtgggctagaactggagggagattagtcccttgtcagggttgcatctgaagtgacggcacaggacaagatggcctcaatggggagagaggatgtctgaggactgatgcctggaggaaatgttgagccccgtagcaggccatctggaaatcctgtgttgggtctctcatgcccggtcttcaacctcagccatcttaccatgaacatcgttaggctggttcctcgctgaccccaagtttgtgtggcgttccaggaatcggtgactttccaagatgtcgctgtggactttaccgagaaggagtggcccttgctggattcttctcagagaaaactgtacaaagatgtaatgctggagaactacagcaacctcacttcactgggtaaggccagtgccatttctccacttattcatccatgaattagatgtttttgtttgagtatgttctgtgacccaggaactatgcagcggttcagaacgcagctgtgaacaagcagccccagcacccatgcttaatggggcctctcctgggtatcgaggcccatctattgcagggaccatggtggttctccggtgtgtgtctgagcttggcatgggcttctgaaatacgaaatccccattcttttggagggtcagtgtgtgggtacttgtgatcttatttcctatttctttttttttttttttttttttatttttggtgatgaagggttctcactatgttgcccagactgatcttgaactcctggctacaggcacgagccaccatgctttgcctgtggttttgttttctatcagtcaaaaacttttactgtgttccttagaaattttggcaccaccattttgctgctcctaagtcagacttgtccaccctcagaacactgaagacccaagtgttgagcccaggctactggaaggggttgtcctctgcatggccctccctcaacctgtgtctttcccgtgagtgtagggtatcaggtcggcaaacccagcctcatctcacacttggagcaggaggaggagccgaggacagaggagaggggcgctcaccagggcgcttgtgcaggtgagcgagccccaggcaaagagcggtgctgtgactctacctctattcagtgactggggtggagggaggtaggttagggagtgtcacccagggaaattgagagatgctccttccctctttttgcccatccattctctgacaaatcttttggtccacacactccttcatctttgactttcacattcccattattgggctctttgtcccattctttcatatttgatgtttctgatcatccgctttctgtcattatcaacatcatctgaattgccttaaatttcttttttcttttttttttttttttttttttttttttgacggagtctcactctgttgccaggctggagtgcagtggcatgatctcggctcactgcaacctctgcctcccaagtagctgggactacaggcatgatgccgccatgcctacctaattttagtattattagtagacatgggtttcaccatgttgtccaggctggtctcgaacacctgacctcaggtgatccacccacctcggcctcccagagtgctgggattacaggcgtgagccactgcaccaggcctgaattgacttaaatttctacccctggcattgccaaatatctcacatgaccagattttttaacaattgcttttgcaccacttttccttacatagccttaggatctgccaagaaatccacctgtcattgtcaccatcatcccaccattttccttttccaacaattaatacttttccaatttgtttcagattgggagactccatctaaaaccaagtggtcacttcttatggaagatatttttgggaaggaaacgcccagtggtgtgacgatggtaagatttccgtgggataattctggatcttccttccacgtctgaggagactggggcagcctaggttagaaaagcagttcaacaccagggcaagcagcttccctcagaggagactgtgtttcagagacactgggtattaccaagatggagacaaccctaaagctaacctcaagctactttacctagagtgtctctgagtgaagatttttatagctgtgtctcagatattgagtgttggggctcaatgcagtttttgttttattttatatttatgctgtacacttacttatcaatttagttttggtggtgtttattttttggggggcagacagtcttgctcttgttgcccagtgcagtgggcaacatcttggctcactgcaacctctgcctcccaggctcaagccatcctcccacctcagcctcctgagcagctgggactataggcgtgtgccaccacacttggctgatttttctattttttgcagagacaggatttcaccatgttgcccaggctggtcttgaactcctggagatccatcagcctcggtctcccaaagtgctgggattataggcttgagccaccatgcccagcctcaattcagtggtttttgtttgtttgtttttgttgttgtttttgttttttgtttttttttttgaggcacagtcttgctcttgtcacccaggctggagtgcaatggcacgatctcagctcactgcagcctccacctttcaggctcaagtgattctcctgtcccaccctcccgagtagctgggattacaggtgtgcaccaccatgcccagctaatttttgtatttttagtagagacagcgtttcaccatgttagccaggctggtctcgaactcctgacctcaggtggtccacccgccttggccttccagagtgctgggatgacaggcgtgagccaccttgcccagcctcaattcagttttaagcagtgaagaaatgctatatgcaaaaagctttgaaaaagtaacacatgtggagccttgtggcctggcattcacctattgtccttgatggagctcaaatggggcagggacagcacgtttgcacggcagatggttacagctctagtcatagtaatgtgcttctatctgttcatagcagtgtatgtggggatgacgcttagggttgcaatgaatatgagaattgcctttgtcagcacttacgtcttaaccaacaggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgcta

SEQ ID NO: 2185 - DNA, 23037 bp, Homo sapiens; identical to SEQ ID NO: 2184

SEQ ID NO: 2186 - DNA, 82616 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaacttcgtgtcctgtgggaaatgttgctgtccacggttctgtcactcaggggcaggggcgggacaagccagccgcacacccctactcccaaagggtgaggcggaaaagag

SEQ ID NO: 2187 - DNA, 82616 bp, Homo sapiens; identical to SEQ ID NO: 2186

SEQ ID NO: 2188 - DNA, 82061 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcac

SEQ ID NO: 2189 - DNA, 82616 bp, Homo sapiens; identical to SEQ ID NO: 2186

SEQ ID NO: 2190 - DNA, 82616 bp, Homo sapiens; identical to SEQ ID NO: 2186

SEQ ID NO: 2191 - DNA, 82509 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaac

SEQ ID NO: 2192 - DNA, 82616 bp, Homo sapiens; identical to SEQ ID NO: 2186

SEQ ID NO: 2193 - DNA, 53847 bp, Homo sapiens
gtctgcccaagtaactttattcgtgtcttctcaaacatttcagatcaaataatgccattttctaatcttgaaaccagcaagattagaaagagaatgaggccatcctttcactcagactttcccagttactcaagattgtattcaggaacgaagtcaaactcggcctcacttcttaattagaataaactagaatcaggtccattgcataactgctaattgttttgcaccagggagccacaaaggaagctaaaactagcctttctaagttatcctaagtttttactatctaaccagcacttctgattttttttcccttaaaactctaaagtacaggtgttgtatgtctgccgcatctgaaaggctgccccggaaatcagagcctatctagcgggaatgtctgggcagtcacccccatcctgcgcgcagatagcaaagggctgctggcaggtgtcagacacacggtaccgcaacagcagtcccgaggtctgagattctgaatgtcagcaggtggctggagagtatcaccagagccactcaggaaccagccatgcggaatggctgggtttcttattgaacatgaaatgcttcctctttggcctggactgttttgctaaaattgttagtgggttttggggcaggccagtgtatgggaaacttttttttttgttggggggggcgatggagtctccctctgtttgcccaggctggagtgcagtggcgcaatcttggctcaccgcaacctccacctctttcttgggttcaagcgattctcctgcctcagcatccctagtagctgagattacaggcgtgcgccaacaagactggctaagttgtgtatttttagtagagacgaggtttcaccatgttgggcaggctgatctcaaactcctgaccttaggtgatccacccgcctcggcctcccaaagtgctgggattacaggcgtgagccaccgcgcccagccgggaaacatttaccagggacaataaaggcttagaagaaccttttggggaaactttgtgaggagcacaattccagagggcccacagcagccacagcctcctggcgtgacaccaggcacactgccggctgcacaggttgctgggcacaggcaggcacagccagtctggaagagcagcccgtcttaaatctttggtttctttccaaccaggagcaaacattggtagaaagagccagggcatatttactctttacacccagaattttcattcattattgaaccatttggcttgcacagtgctctctgataatgtggtccataaaaaccaccattaaagctgccctttcacctgatctgggtggggctaaacgaggaaacgagaagtttcctgtatgcttcaaaatataaatcaatgccaggaaattctgaaaatggatgctgcctgttaaacatgaaatcactaagggagcttctgcaaaacccacccggcagcatgaggaacggtgtctacagcgtgctccaaacggccacggccccgctccttacagatcaaagtttaagccgcatattctcatatttcaaacaaaactacgttacagacatcatctacgtgggcacggatacacactaaacaaggacgtagtacacaattgaggggtgccccggggagcgcggcaggaatgccttccgggaagaatcctctggtcgccggagccctcgcgctgcagaggaaaccagcgatccatcgtggcttcgaggcaaaagacagacatccgagacgcagtttacactactctggcttaaaaggacaagatgttcaataaatatagagaactcagtgtgaagaaaagacaaggacaaatctggaccacgtgtacagacttcaggccctgcctcagaggagtcctgcgggagtccaggaccggcccctcctccacggatggccagcttcctcctgactgcccccaagcccggctgtgttaagcacttcgcgtcgatataaagcattggtatttgacattttaacagtaacaaacttgccagtgctttacacactgccagcttccagagcttatcatccgtgctcccagaacagacgccaaggtcatgctcccagccggattgtcgtagcctcgccgccgtgatgaggcaggtgtggaggccccagcagccttcccggcgctggcgtggaggcccctcccgcggatcacctgaagcagggccacgttgcattgcagttgcacagtattgtaaggatcaagcagcgatgtcctaaccgtaaacgaagaggaaggtgaaatgaaggcaaagagaatcaaccacttcccaaaacttggccacaaaccgttacagaataagtcctgcaaagtggatcaaagtgacccactgctacctcaggcccagatggtgtgacctgcgtggaaatcatataatgtccctaacattattgcaatagagccactaacgggccattttctaaactacactgttgacatcgttaaaacctaagaggccagtgcccccaagtgagcagctgcatccgctgagagtaagcggcgtgggctgcaacccgcagatgcgtacagaactgaaaatgccaaatatgtacacaaaattgttgacaaaagggttttcttctaaaatcaagatttaactatcaaaaataaatttctacatttaaatgtatatatcaacataattggtctgtaataattatcttaaatagttttcacactttcccagtttgtgagcaggacgccggcttctcagctgtgtgagtctggcttcggattctcttcaattcctcgtgcaaagagtcgaaccagctggcagtggactctgcagagacaagcggccacgtgtaaaccccacgtgtccctcactcaaagctggcctgagccccactcctggacaggggctgcagtaaaccccacgtgtccctcactcaaagctggccctgagcaccgctcttggacaggggctgaagtgggggtccatcccccatggaacggtcagacgtcaccgtgggctgtaggagtccagcccacaatgacgggccctgggcgtggaataattcacttagactcccgggatgccgagtttgtaaaggggttgccaatggccaggtgggaaatctgggcatcggtagacctgactcgaactccagcacccccatggaaagcagagcgtccgctccagtgtctgcccactccacccacccacccacctccattttctcagcagtactgagcgcgcaaggcctgcgaggagtctgtgcggggcgactcaatgcgtgtaagagatgtgtgaggaatgctcagatgagaaggacaggtggcccaacgccagcaagagccttcgggcttgaggaacaagttgggggtccctggaggtcccctgcccaggggctcggtggccacagtgagtccgtgggtgagtgccatcttcccacacaggacagctctatttatctcatttattaatgatatcacagcctcctcagacgtatttcagtaacctaaaccccttcattaagtgacaggctggggcagggcacagtgactcacgcctataatcccagcactttgggaggtccaggcgggcggatcacctgaggtcaggagtttgagaccagcctggccaacatggtgaaaccccgtctctactaaaaatataaaaattagccaggtgtggtggcgggcgcctgctacttgggaggctgaggcaggagaattgcttgaacctgggaggcagaggttgcagtgagccgagacctcgccattgcactccagcctgggcaacaagagcaaaactctgtctcaaaaaataaaaaaatagaaataaataagtgacaggctgtttccatggagctgagctcacacacacacaaattatatttttaaaagcgacgtgctgctcaaggcatagccatatttatcaagatagacaggacgtatttcaagaatgcctgtcctgattttcaaattattctatttctttaataaatacatacaccaatattaaaaataatcccacttcccaaacttgtcaaatgagttgacagaggaaagtccctgtgcacggctgcctggggtggccggtgttcctgggacctttcgacagcctcttgccatcaccaccgccctgacagaaagaaagggggcgcgtggccctgggcctggggaggggcagagacctcctcccttaggcttgttcggatgcgaatgggagaagctttcttagagccgcagctggctggctgaggagtcactgaaagtggggcgctgtccacagagatgcgtgcatcctcttacatgctgtgacttaaggcacccaagggccatctgacacccagctttcgttgcagacaggcgtgggcctgctgaccagcctgctatcgctctcacgccagccacactctgttaacgagcgtcaagctgggcttccttgaagtagaccgagctcttaccaacatctgccaagagttcagaatccacctgagctctaccgttccccagtctcatgtaatttgcacgcccacacctaattcagtggccttttgaaaaaatcaacttgcttgttactgggtctttccatggagaaacaattttctttgcactcagattccatctggttatgtgatacatcacagacttccaaatacaatgggccccagtgggtgtggggaggacaccacttcccaccctccgcccagccagccagaggaggggtgtggcacctgccccagggagaccgaacatccgtgtgtggccacacctgcctccccgcgtcccctaggctgcgtggcctccagcacggggcgtccctctggggctcctcctctccttcccatcctcggggtgcccttcccagccctgctgcctcctgcccctccctgcacggagcacctgcacttggtgattgactgtggcccttgaggccagcggttccctggtggattcagtggacaaaggactgcctgtaaaggcggtttcctttgtttgccttttgaaatttttttgagatggagtctcgctctgtcaccaaggctggagtgcagtggcatggtctcggctcactgcaacttctgcctcctgggttcaagcgactctcctgcctcagcctccggggtagctgggattacaggcatgcaccatcacacccgactaattttttttgtatttttagtagagacggggtttcaccatgttggcgaggctggtcttgaactcctgatctcaagtgatctgcccgcctcagcctcccaccttttgaattatttaggagaagagagagagaatgccagggcaaagagcccaatgccagcctggagcacagggtgtggaagaggaaaagaatgaaatggaggagcttcaaacacccatgaaaattatctgcaaaacaaaatgctgaggactcggcaccctggcatctttccagaatgtgggtaacggcatctcattcgatatttgacatagggagagaaaagtgcatttataaaacattcttacgttttgtgtttataaagccccagggaaccccccaccctgggtggggcagcttgtgacagacacctcagggctcaaggggatggcgctggtggctggaggacccctgcacgcacctgacctcgatggcagggctgtgcaggacctccccgtcgcagttccaggagctgttggagacggtgcagcagcaggaggggtggctgctgcaaatgtgcccaaagcgcttcttccccccctccttgaggtcgctgtcctcatcctccatgtgcttcgacgtaaactggaatttcttgacgcgataaacttcaacaaaagtgaagtcaaactaccaagaaacagtgagagggaccattcagctctaaacgtcatcgtctgggtggggcagcagaacaccccaggcctgacagcgagcgctgtcaggcctgggtgcacacacggcccttctcggaggatgcgactgcttgtgcaggcccctggagttccctttccagctgaactgacagctcagagatgaagggaaacctggcacccacctttcccggcgcccaccttccccggcgcctaccttccccggtgcccaccttccgcggcacttgtcaaaatgacttctaatgcttttagaaaccacagcttatctacaatgacgaacgctttttacagaattctgataaataattagcagtgattattagaattttgtattctctttttaacaagcactacttaaaaagccacataaaaatagcattagactagatcttaaatagaacttaagtaaaaaaagaaatgtgactaaatttggagactgtgaccaaaagttccgcttcccccaacatgactagactcgggtcttcctctgcataggctacagaaagatgtggtagaagggtccgaacagaacccatttctgggagcctaaagagtctattttcagtggcctgcaagggccacttacatctttactgtgtcgctttgttctgtttttaaataggaagagaaacaacgggtaagaagttgtattataaagattcatacctcttagtttctgtgctcaaatacatgtgtgtgtatatgtatgtatgtatgtgtgtgtatatgtatgtatgtgtgtatatgtatgtatgtgtatgtatatacacatatatgtatatatacacatacacacacatgtatacatacatacacacacacacacacacacacacacacatatatttgagatggagtctcactctgtcacccaggctggagtgcagttgcgtgatctcagctcactgtagcctccacctcctgggttcaagcgattctcatgcttcagcctcccgagtagctgggattacaggcgcacgccaccacgcctggcttttttgtatttttagtagagatgaggtttcaccatgttgcccaggctggtctcaaactcctgacctcgggtgatccgcctgcctcagcctcccaaagtgctgggattacaggcatgagccaccgcatctggcctcaaaaatttatcgttttaaatgatattttacaaggagtagttgtaaccaggagtttaaagtttgtgaaattaaaaaaaaaaaagtttgcccttccttcccttgaattaaataatgaattcctacaacacataaaccagggactgctggaacataaattactcgccagtggaggctccatgcaagagcaccccacttacctggtcctgctggttggtgtgcctgatgagaaatctcagaaaattgaacctggagcatttccggatgaggatgaggtcagaagacccgtctcccaagtgggcagccggggagaggcccctggggctccggcgacaagcacaggacatgtttgtggcattgatggccagaaacttcccacagacgacttgccactcctccacgtcctctgaagcacaaagaaccacggagatgtcacagttacaatggcgccgggcagcgccctgcaccaggacggtgggaggccattcgggctctcacctgctcatgcatttagcagacacttcatgcaatcgactcttcagctcaacaccaaaaacatccaccacggaactgtccgctccccgcaggaagtggtacccaaaggatcacctcccagaaggcaggactgttgtccctctcctcacttggtgacttttggacaatttagaacaagggtcagcaaaccaaggctgtgtgtcagatccggcccgccgcccgtctgtgtgtggcctgagagctaagaatgcttttcacgtttttaaatccttgaaaaaggtctggcgcggtggctcacgcctgtaatcccagcactttgggaggccgaggcgggcagatcacctgaggtcaggagttcgagaccagcctggccaacatggtgaaaaccatctctactaaaaatacaaaaattagccaggcgtggcggtgcatgcctgtaatcccagctgctggggaagctgaggcaggagaactgcttgaacccggaaggcagaggttgcagtgagctgagattgcgccattgcactccagactgggcaacaagagtaaaactctgtcttaaaaaaaaaaaaaaaaaaaaaaaaaattagccaggtatggcggcaggcgcctgtaatcccagctactcaggaggctaaggaaggagaatcgcttgaacccagaaggtggaggttgcagtgagccgagatcgcgccactgcaatccagcctgggtgatggaacaagactctgtcccaataaataaataaatattattgactgggcatggtggctcagacctgtggtcccagcactttaggaggctgaggcagtcagatcacctgaggtcaggagtttgagaccagcctggccaacatggtgaaaccccatctttactaaaaatacaaagattagctgggcatggtggcacatgcctgtagtcccagctactagggaggctgagggaggagaatcgcttgaactcgggaggcggaggttgcagtgagctgatattgtgcccctgcactctagcctgggcgacaagagtgaaactccatccaaaaaaaaaaaaaaaaaaaagaagagaaagagaaaaaaatcaaaataataatattttgtgacatgtggaaattctatgaaacttaaatttcagtgtccataaataaagtttcatcggcagatggccatacccactcactgtacactgcctaggctgcctctgctggacagagactgtgtggttgccagggcctgaggtggtcaccaagcaagccctcaatgggacatctgctgcccccacattctagagcacctgggacaggagtccagactcagcaccacaacagcgtttcagaaagggtaacggggcctttcacaaaacccactgctccacacagccacacacggcaagtaacagtgacctgacgctgcctggggctaagaagaaatggatgcctggtgccagacaggaaaaaggaaaagcacaggtgggcagggagaagaggcagtgccctgagagaggacagaaacccgcactccagcacacacagtgacaacactgagcctgtgttttaggaattacccgcagcttccaaaccatacagtgctttcttctgctcctcctccagctgctgcttgctttgcctgcaaacaaagcatctgaaagacaagaatatcatcaccttttaaatatggagctgcaggtgcagtgcgtatgcttggcacatatagatgtatttacattcttttcacatacgaaaaaattccatttcaaaggcttaacaaaatattttttggcatattaattagaggtttcagaatgagacctacttttacaatgacacattcaacatgtccttctctaaaaggtttggacatgaggagaagcacagcatgaggacgctgaggtgccacctggagacggtttctgcctggccctccagctaacatagcctggctgggagaaatgactgaggcactggttcccccagcggactcctggggtgaggactcatttactttcagaaaacaaatcatacagggtttatctgttacagtcaataacaagcaaataactcagaaccatcagcttagaacttagtcattcgtctagcacgtccttctgatcttgggggctgccggattcacgctgtcaaacaggacactgtttgcactgatggaaatcgctcatcagcagccgagttctttaatgcactgacgcaaacagcatctgcctctacatattctgattttatggtctccaattcttcacttaaaaaaggaaaggagctagaaggaggttctgaagtctgcatgacttaaaaggaaaggacgtgagtgtccttcacaaaggcgcagctgtctccacagccccgtgtcctcagccccaggcagagcagagacaggatgaccattcaggcgccctccatggtcactagggaggtcatgcggcctgggacaactatgtttagatttatttaaggttctatttacactggtcgcatattactgaatacactgtgtgggggtgggggcggagatatgccaggtgaaaggagtccctgcttgttcagtggcgtagccaccattgcagagcctgcagtggccaaactgggggaccaaatgtaaggggagagcgcagcgtttccagctgtgttgtctgcactcagcctcccctccccggtggggcgcctctttccctttgcatcccctctccctgggcagctgccctggctctgccccccaacccctggcaccagcccttgttgccagcccgagccttcttgctgagggtccctgccttcctgtggggttgaaggcgtggctggcctgggctctgctaaccttagagtgggctcctgccttggagcatggggctaacatgggtgagggtctcagccaggggtgtggacaggagggtggctgctgagagtgcacacttcagccagctctaccaacggtcctgccaccagtgccctgcacacgcacagtcactgataaggtgtctgccatcctttcctgcctgcatttctcctccatcaggcccctgcagggggtaaagggaaccccagcagggaaagaccctgtgctcagcccccactccaacagtgggtgtgggaccctcccccagagtcctcatccctggcacagcagcagctgcctgcgcaggccatggggacagagatggggacagcaagccccatgcacgcctaggccatcatgggcatcataggcatcgtgtgtctgggcacgctacatccggcaccttccaccacatttggaaaatacttctgcattcaccttcctaaccgtcctgcttcatttcccgtcatttgcaagagaaacacacaaagcaatgcacttaccctgcccggcagggcttcctatcccttggagatcccaccgtgtgttgtgcagggaggaaggacactgtcccttcatagcagtggtgggagaggaaggtctttaaacctgggaacagagtgcagtgaagaaaaaacatccacaagggtcattgcttggttaggatgctgtgctgggcagcttcagaaatgtcgctgagcgcgcatctgcctaaaccgtctgcaggagggagaggccgggcctgcttcaggccatgtcaccattgaaggcagtggcagggtctctgccctccctcaggacaacagcacgtctagtcatagtgctggtgccttctgacacccagtgatgctgggacagccagggctatggccactcttgacgctggcaaagtggggcctttgccattagccacccctcatagcctcgatgatgtggcctgtgggctccagtggctcagggtcatcccctccacctcttcatgagggtcagtgatgcccccacctgcctcagggcttggcccccactggggtcagccacagcccctgtgacgtcctgaacagctcaggacagaggccagggccgctgccacccaaagtctggggccaccctccaggcaaacgtgtgcgctgtccacggggctgccagcagcctggcacccgggctgtctgggaaacaccacccagcaggacagcagggactgggcaggaggcaggagaggggccccagggtgtcgtgggccacaccaggagccaggccgtgtcctgtgagtctcagggcgacttcactcctccgtgtctgatgctggggctggtgctgccctgtatgacatctggtgtggcagtgacggcctgcagggccgtcacacacaaccttacccccgacacacagaggcctcacatcctcatccgcagatggcaagcccacagccaagtgtgcaccgcccaggggtgggggaagctgccggcaagagcagtctggctcctaggacatctgtgtgcctgaaagtcagctcccgactgtccctaggacagccccgtctgtgggtcttgcacctggcatgggccaggtgcctggaatgcactcagcgggcgggcccttccaggtggctgcagctccgcctccctgcagagtggctctggcctctctccctgctcctcccatgggggtcccacaaggacgtcgtgtccacggccctgggaggaggccgacccactggtcagcaaccttccaagccggctcctctctcaagtgcagggggcaggggggcagctgcctcatcacccagacgcagcctccagggtggcgcctcaccgacatctgatgtcccggtttctgtctgcccctagatgggccccagatgtcctaccggcacctaaaactccacgtgtctcaacagagtgtgtcatttccacacgctcattctccttccatgccctctgtgctgctccagaacaaccgggtgctttctgcctcacagccacagaacccaaacccgctttcctgagagcatctcaggccctgtggccaggatggggatccagagacccggaaggcgtctcctgcctcggggctctcatcctggtgggagggacagagctgcagccactgcctgtggtgatgggctgagggcaaaggggggggccaggcatgcaggggggctgcccaccaccccaccccagcaggcagggacagggagggggcatcccaggggcattctaggcagagccacactgggctcaacaaagggcagtcgggagaatggcacaacccaaaccgcttcctaaaattctcgcggcttctctaattttctcggtattccctttcttaataagccttagataaatacctcactttgccatttcttaggttttaattttcaagccacactagtttttaatttcattaaatcttttcaagcttcgtaaagtttgccaaatcactatttctttctctcataagggttaagattttagtatcaggaattactcgatttaatttgatacagatttatctgaaagcgaactgtaaagaggcgggaaagtcgaccgggcagcgagaatggcacacctcatggtctacatattttcttctttctttcttttcttttttttttgagacagggtctggctgtcgctccagctgcagtgcagtggcctgatctctgctcactgcagcctccaccttctgtgctcaagggctcctcctgcctcagcatcccgagtaactggggtgcccggctaattttgtttttaatttctgtggagatggggtctccctatgtcgcccaggctgaaattctacttttctttttttttgagacagaggtctcgctctgttgcccaggctgaagtgcagtggcacgatctcagctcactgcagcctctgcctcccgggttcaagcaattctcctgcctcagccccccgaggagctgtgactataggtgtgcaccaccatgcctgacttattttgtatttttagtagagacagggtttcaccatgttggcgaggctggtcttgaactcctgacctcaggtgatccacctgccttgacctcccaaagtgctgggattacaggcgtgagccactgcccctggccaattctatgtatttttaaagttctccttttccagcgtttaaaagctggtgacgtcgcacccactgcctgatgtgtgcagactgcaactcttgtgtctgaactggcaccagccttcatttctggttcattctaaactctgtggtcgggtaacaggtcaccgccgcctggcccgaggccccagcagcagccccgggagcctggaggacctgcatgttccgaagcccacccagacctgccgtgttggatgctctggggggtccccgcagcctgggttctaccaagccctccagaggatgcaggtgcccaccacagtctgaggaccactgggctcaagaaagagtgaggcaggatgcgggcaacctctttgtgcctgttttctccgctataaagtggggcaggagcacctgctggggtgagaagagcactgtggagaatgaaagcttttgggcttcagggagtgcggcgtggcattcgctcccactcctcctcctctgtgcccactgcggccgagccgcaggaaggcaggatcttgcctgttttgttcatggacacgtccctgcctcaaaaaccaggcccggcatagagcaggggctcaacaaatacgtgctgagtgtatctcacttgtatggctagctacggtgtaaccccaacaaaaccacgcaaccttgttgaatgaagtaaaggatacctgtgcctgaagttacagaagagcttccacacagatatcccaggctgaatttctgcacaaagttcttgccactttgactaataagctcagagtgattataaaactattgttttacaggccaggcatggttgctcatggttgtaatcccagcactttgggaggccgaggtgggcagattgcttgagctcaggagtttgagaccagcctgggcaacagggcaaaaccctttgtctacaaaaatatacaaaaaaaaaaaaaattagctggtcacggtggcatgtgcctgtagtcccagctactcgggaggctgaggtgggagaatcacttgagcctgggaggtcaaggctgcagtgaaccgtgatcgtgctactgcactccagcctgagtgacggaggaagactgtgtctcaaaaaaatttttaaaaaatatattttaaaaactattttttttccaattaatacttccacttgaacagtttggggtggcctctgtcacctgcctaccagatgtgagaggctggtggcctggcgtcttggggttccagcacctggggttctggagtgaactgcgtccgtcatggtgtctactctgtggcttatgcttgggtccagggggcaggatctggtttagagcaatccaggttccagtccagaccctgccacgttctggccccggcacatttcatgaggcccttagcttcccgtctgtgagcaggtgggggcccacctctgacggtgctcagtggattcagtcaggtaacatctgtgaaggcagtcggggcacgaccagcggggagcgagtctgcattattctgagttacctgaaaagtcgtatctggcaagacccaaccaccgtttcttctcactgtccttgatgatgtccccgtagaagccgtagcccagcagggacacggagtagcgaaggagtgtgctgttgtggtggactgaggacacatccatggccagcgagtcccctgtgggagagaacggccgtgagggaaggcagcccccctccagccccgccccatccactccatccccttcaatagcactttgcaaacgtgggagttacttttaaaaagtgtgaaacaaacagaacgcattcagtgcaaggattctctctcttggggtgttggatgccatattttttattcaaatgactgaactccactcaaatttctaaaacaggctcggggagctatcctgtggggactgaacaagagtgtatccgtgaggctcatgaaatatctttaactgaaaggacggtggttttagaatgaagaaaaagtacatggcattttaaaatacaaaatcaagccgagtgcagtggttcacgcctgtaatcccagcacgtggggaggccgaggcgggcagatcacctgaggtcaggaatttgagaccaggctggccagaatggtgaaaccttgtctctactaaacatataaaaattagccaggcatggtggcgtgtgcctgaaatcccagctagtggcgaggctcaggcaggagaatcgcttgaacccgggaggcggaggttgcagtgagccgagatcataccactgtactccagcctgggccacacacagagtgagactctgtttcaaaaaaaataaaataggccaggtgcggtggcccgcgcctgtaagtaaccccagcactttgggaggctgaggtgggtggatcacctgaggtcaggagttcgagaccagcctggtcaacatggtgaaaccccgtctctactaaaaatacaaaatgagctgggcgtggtggcaggtgcctgtaatcccagctacttgggaggctgaggcaggagaatcgcttgaacccgggaggcggaggttgcagtgagccaagatcgcgccactgtactctagcctgggcaacaagagcgaaactctgtctcaaaataaaataaagtaaaatagaataaaataaaatgcaaaatcagaagtaggccgggcacagtggctcacgcctataatcccagcactttgggagggcaaggtgagaggatcacttgagcccaggagtttgagacacagggagaacctgtctctacaaaaaacacaaaaattagccaggtgtagtggtgcacttctgcaatctcagctacttagaagactgaggtgggaggatcgcttgagttctggaggtcgaggctacagtgagtcaagatcatgccactgcactccagcctgggtgacagagtgggaccctgtctcaaagaaaaaaatatcctgaccaggtgctgtggcttacgcctgtaatcccaacactttggaaggccgaggcgggtggatcacctgaggtcaggagttcgagaccagcctgaccaatacggtgaaaccccatccctactaaaagtacaaaatgaactggacgtggtggcgcgagcctgtaatcccagctactctagaggctgacgcaggagaatcgcttgaacttgggaggtggaagttgcggtgagccaagatagcgccactgcactccagcctggggacaactgggaaactccatctcaaaaaaaaaaaaaaatcctaagtggctattttaaaatatacagtttctgtgacttcaggtgaggcacggtaaccctgtctactggggtgaggaacaggcgaaggcacaaaagatctgtcctgccagagcccaccgtgctgagtgccatgggcagccccttctgctcttcctgaccggggctctgcatcctggactgaagcctcgaggcctcacagaggcatgcgttccacagctggcagcccaggcacagctgcccgtgcccactgccacaggcagtatggcgggacgcgggtggtttccgagcctcggggcagcagcctctggaggaggaactgagcaagagtcaggtgagctgagtacgggcatcgcgcatgtggtggattccgtgggaaagaactcggcccacactgggcgtgcccccaggaagcccgtcctgacaacgtggcctcggagctgcgtgctgagtgggatcacagcgcagcgagcagagcaggggacacagcgtgacccacggccaggacaggacggcaacggctggaacacgcgacggggaccagagtgggacaggcctgggggcgcaggaggcccggctgccaccgtgcgcatgcgcagaggaggggctcaccaacaacgatatgcagcgccgaggtttctgcgtcgctggtgcccacggtggagtaacacacgcagtccgttgaccctgtaaagggaaaaagaaggtcccaaatagcatcagaataacagaattgtaatcgcctcccaattcagtgagtggtacctcattcctttccttccatggccctagagtcaacactaaggaataaatagaatttacctacaaaatgaatatagaaaatactagcgttgattcctcaagaatattgagattgggccgggcggtggctcacgcctgtcatcccagcactttgagaggccgaggtgggcggatgacttgaggtcaggagttcgagaccagcctggccaacatggtgaaactccgactctactaaaaatacaaaaattagccaggcgtggtggcatgcacctataataccagctcctcaggaggctaaagcaggagaatcgcttgatcccgggaggcaaaggctgcagtgagtcgagatcgcgccactatccagcctgggcaacagagtgagacttcgtctcaaaaaaaaaaaaaaaaaggagccaaaaagttaaaaaaatatatatatgtgtgtgtgtgtgtgtgtgtgtgtgtgtgtgtgtgtgtgtgtgaacatttacaattataggcataacaaaatttttttttttttttccgagacggagtcttgctctgtcgcccaggctggagtgcggtggcgtgatcttggctcactgcaacctctgtctcccaggttcaggcaattctgcctcagcctcccgaggagctgggattacaggcacgcgccaccacgccctggcttacttttgtattcttagtagaggcagggtttcaccatgatggccaggctggtctctaactgttgacctcgtgatccgcccgccttggcctcccaaagtgctgggattaggcgtgagccaccacacctggccctcgtaaacttctgaaacagctggatgcggcaaaggtcacacacagccattacttgagatcttaataccaggacagccaggacaggcagctcaggtccctgcttcagcccgatgttccccgtgaacggggccggctgcggcttatgcatctttttatcctgcgcttcactggctcagatgaaagggaagctgcagctgccccggctgatcgcacggccttccctctgaggaccatgctcaaaagaatgatttgcatccacaatgaccacccatacctgtgggagtagctgtgctggttctcaacattccccacacaactgaatacgggagttcctcatccacccggccagcactgccgccacccgagtaacgaccaaccacatgctcccgttcacgcgagaaggacggggctccaggggggttgctcccaggacatgcgcatcatctccttgagcctctctgtgcctaagtcattagcaggcaatgctggctgaagttacaagcagcagatgcagttacaggctaacacccgatgaaggaccgaatgaatgacgatctcttcttcctatcaatttgctaatgcatctatactaatacatatgtggaagagacttggaaggtaaaacatgctacatcaggtctcaaagcagccggagccatgcctttcagatgctccagtgacatctgtcccggaggcagccatccacgggaggcagctcaacaccctccagatctcaggaccccaacccccacctgcccctcctgcctctcctgcccccagccagcaagacaagcagtgacctctgcaccttctagcggctggaaccctggagcatgagtgagttcaggtacctgctgccaccaccggccgtgcgcatccaggcggcctcccacagggtctgtggctgtcaggtctcactcacaactcttgtgcccccaggctgctccccaggttgccatggtgaccgttacagggccacccttgggtgtctccctcacccttactcctccactcaaggcgatgctgcggagcagagactccacacagccccccaccagctacaccccggagtctcagaccccatgcagcgcccttaccgtccaagccaccagcgttctcaccggggcccacatgctcttaggaccaaacgcagagagcgatatcggagcagagtcagacgtcaccccctgccgaaccaccgcctccaagacctcctgctgcatggcagagtggaactcggcatctccctcgggccctgccctgcccctccacccccacccccagccacactggcttccttgtcccgaacacccccagctcctcccacctgctgccctctgcaccagctgactcccggcctaggcccctcacctgtcacctctcagaaaggcctcctggacacccatggaaaggggccacaaagagaccctctccccagaccctcccccagtggcatttgctacaatgcgcacccaccctgggaaaggcttttatgcccacatttggtggggtgcctgctgtcctctcctggggcagaggccacagccaaggcctagaggagggcagggcacacagcggtacccccaccctgaccacggggcagggcacacagtggcacctccaccctgaccatggtgaagtgcagcctgcatccccacgagcactcctgagccgcaggtctcagctcctgaggtcgttgtggattttaagagctgaggattttagggcttagcactgccactggcaaatggtgacaaaagacaggtttcttgcaaacaaggtaagaaccatacagcatagatgagaatgcagaaaaacagaattcatggaatccagaacgcaccacatacaaagttaaaagaccaaaacctaatttggaaaagagttgcaagacacaaaaaccaatgaagggcaaataacgtataaacaatgttatggtcaattagaaagtgacaggccgggcatggtggctcacgtctataatcccagcactttgggaggccgaggtgggcagatcacgaggtcaggagttcaagaccagcctggccaacatggtgaaaccctgtctctactaaaaatacaaaaattagccgggcacggtggtgggtgcctgtaatcccagctactagggaggctaaggcaggagaattgcttgaacccaggaggcggaggttgcagtgagctgagatcatgccactgcactccagcctgggtgacagagcaagactccatctcaaaaaaaaaaaaaaaaaaaagtgacaatgccctcttgcttccccatgagaacatggactaagcaagggaaaggaagtttacaaaagcacacaatgcaaacagcaagaggacctgtgaaaagcagtgtggcctcacacataatgaaagaaatacaaataaagagagtaaataaagatagtgaataaggcagcatactcagtctatcagatgggataaaagttaaaccacagacaaacctccaggctgtgccaggcttggggaaactccccctcccagccccgtgggtggcctttatgggagaattaagtgggcccagagactccacgtcaagggatgtccacaaggaaatcatgacctggagcctctgagagccacacgtgcacaggggccagggtccttcacgagtgtggaagatgcagagagagtatggaaagaaggatgggagtgaggggcctggggtgaagacagcaggagacggtgccttgatctcaggcacttgtggccatagggagacagtgcaaggccatcaacattggttgtctgggtcattcaaagaatcggaacgggctgggtccagtggctcatgcctgtaatcccagcaccttgggaggccaaggcaggtagatcacttgaggtcaagagtttgagaccaccctggccaacgtagcaaaaccctgtttctactaaaaatacaaaattagccaggcatggtggtacacacctgtagtctcagctgctcaggaggctgaggcaggagaattgcttaagcccaggaggcagaggttgcagtgagccaagatcgcaccactgcactccagcctggacgacaaagtgagactctgattcaaacaaaccaaccaaccaacccaaagaactggaacgcctcttgaaccagcgccagccagcaagacaagtggtgggtgactggccaggcatggtggtgcacgcctgtaatcccagcactttgggaggcagaggctggtggatcacttgagtccaggagtttgagaccagcctgggcaacatggtgaaactccatctctacaaaaatatgaaaaaaaagttggccgagtgtggtggtgcacgcctgtggtcccagctacttgggaggctgaggcaagaggatcacttgagcctggggcagtctaggctgcagtgagccacgatcatgccactgcactccaaactaggtgacagagtgagacccagtctcaaacaaaaagacaagccgtgatctgtgcaccttcaggggctgggagcctggagcgtgtgagtgtgctgagtgtgtgtgaacacagagctcgaccttgcacagctgtgctcagtcattcaacagatatctaagagggagtttgggtgccagggctgggtgccccaccgaggacacatgagtgaaagccaacctccctgcctgtggggaagacagacatcagccaaggcccaggggccctcccgagccgtctgctcccggccagctcttccgctctccccactcctaactgcctggcaggaaccgagaggtcggcggcacacaggaggcctgagaaggatgtgaggaaatccagcagaggctcccccgagatccagcgggatgttgctataatgctttggtttatctgagagacttgttattggaaggggtgctgagagctttttctctattgagctatttctaaagaaccatttctccccttagtgtctcccagcctggagccaggctgttctcattagacaggactcttctcaggtgagtgacattcttctaaaactcatcaggcgatattatgaaaagttcctctctattaataactgcatcacgccttccctaaaagccaaagggaagggatcgtaaccagacgatcatcctttcctatatacttaaaaccatgaccatggtcaacttgttgctaacaattattagtaattcacgagatattatgctaacacaaatccccctaaaatgagtcttgatactgaaaacacccgcaatgtcaccatccgtggggaacatttgcctcacaccattattcacaagctctgtcattaagaaggagtaatgacttaagtttaaaggatgactccctcaagtaaacactggcccacaatgtcacctgtcggaggcaggttagagttgagagcggcacccacagagaaggtggctcagggcctgtccctcgtgagggctagcctttcccttgctttgaggcaaggtggcctctaaacctccaactctcgctcccatccggtgacctgtgacctcacccccagtcctcctgtcttcatccataaaatggggatgactgcggtgctcacatcccagagctgtgacgagagtgaaagtgtgcaccatgccgccaccctcggggccagacacagggccagagaggacagacacctcgtcccctgccaggtcatttgcaaagcctgcaacacaccacgctcaggccctcagcttgacttagcttaacactgtgatttttcaaagaacaaggtggttcctagaaggatgttgaatggaccaagccgaaccagcacttcaggacacagcccagctgttcccgggctcggctaggtcctgcccttggttccgcccccacctttcccactcagtctcctcccaactccccagcccgattcctgcccacacccacccctaactcccggttccttcaggtccagaagccacttcttccagaacgcaccccctgccaacctacccacctgctcccgggcaccgggggttccccactccaggactgcacccccagcggtggggttctcctgccttgcgtgaagcagcctttgggggagtcgggcaactttcctttccacgagtgtctatttcattggggtcatactctcaatgatatccccccaagagtggccctaatgttaggaaatctgtacgaactaaactgagtataattgggttattaagtgtccgaggtggctacttgtgcagaacaattcctaaggacgggaacgaagagaacagagaatgccaggccggctccatacctgcgggaatgattccaatccggaggctactggggaccagcacagcccgggggtggttctggtcgaccccggcgctcctctgcgtcctcccaatcagaccgtgcagcacctcgctgaacataccatctccgccgacacagacgatgctgcaggaggaacacagccggtcagggctcctgcaggtgcggccctctgagcgcagcaggcctgaggcttccagcttcaggaggggcagcctgcacacctggcccttggcaggcatctagaagtgcggctcctgaaatgtccctaagtgataaggtcgtgcctctgtgccagttggcctagaccacgtgtacaaataatgagattgatggcaaatactggctttccttctgtgagtctggaatttgggtggctaggcagagaatgcctgcatgcctgtaccccctcaaaaacactacactctgggtctcaggactcaagtttgcggggcgggaagagtacacctgtgctgctgcatttgtgggagcagagagggtgcactccaggtgacccgcactgcgggagaggcacagcagtctgcgcggggacgtttctcctttgctaagctggctgtgcagccttgctctgtcccgtcagaaatctcagccgagagcacgactctagctcaggcagcaaatcaccagccgtgtgggtggtcttgaggacccaaggcaagagcagaggggacggaataaatgcggacaaaatggggcatgagacaatctaaggagaggagatggagaaaggggacagtggctgaagggagaaaggacgggttggtttcagggtgtgctgtcctatgccgggggtaacccacagggaaccaacactgaggtggcagaatgagaggtgcaggcatggagacagacatgtcactgcagcccagagggaaggcagaggacagggctcaggtttcctggacatctctatagcctacggcagcccaagagctctcatcacccgggaagagagggttgcagggggaaggtccgccggtagaggagcggtgtgagtcgactagggggtgcagcctgaggggcctccctcaagcatgacagcatcaaggtgcctgcccattccccagtgggtctgtctgtgcaggcgcgaccagtctccagggctgggatctctgcccaccacccaccactcaggccacctgctttgggcccggctcccatgggaaggctctttgcccttccccgtagcctacaccttgcaccggggcagccttcccagcggggctgtggtttcgaggacagggcatccttgaatgggcagtgtagcatctgtgtgttagacagacagatcactcagacagacagctcagccgcaggaagagcagccctcactggccaggcctcccagcctcctgcacggcatgtccctgggtttggggagaaggcgtgccctcaagaggcgaggctgatcccttggctagggtgggtgcaataaggtgccagccccatccctgctgaaaagtgaagacgactgtcttcctgccaagctgctgtcgggtggaggtggtgggaagaagtacatggaggagctgccatcgggtggagttggggagatgtgcatggaggagccccctgcttcctggagcccatgaacagaacactcccgcattaggaggggagcaaaggggtctccctgtcagcacctgggggcaggggctccttttatttccctttctaaccttagcaccagcagagtgctgggacctggaggaccctcaataatgtttgtggaatgaataatgatttcaataaatatccgctgcaatttataacacattgctcaccgactccagatggaacagagagaagaaaacaaaaagccaaccaatgacaaggcaattaactacaggggaatagctaaactcaagatgaagagtgaaattttaagcataaagaacagcacagaagagctggacagacttgagtacatgaatttgaaaacttctactgggaagaattaatgccataagcaaaattaaaagacaatttcaaaattagcaaaaatatttgcaaaaatatgaatataaatatgaattgcctattatttgttggataagagaacaaatgactgaaattatggccaacaaaagaaaatgggccaaagacataaaaatcaattccaagaagccagctagccaataaacatatttcttaaaatattagagactttcacatgtcaaattagcagagaaattttatactgataataccaaacatgttgacaaagacagtaaataatatactataagaaagaatgtaaactggccgggcgcggtggctcatgcctgtaatcccagcactttgggaggctgaggcgggtcgcgtggatcacctgaggtcaggagttcgagaccagcctggccaacatggcgaaatcctgtctctactaaaaacacaaaaattagctgggcgtggtgttgggcacctataatcccagctactcgggaggttgaggcaggagaatcatttggacttgggaggccgaagctgccgaggtcacgccattgcactccagcctgggcaacaagagcgaaactctgcctcaaaaacgaaaaaaaaaaaaaagaatgtaagttaatagaatctctttcgaaagcaatatggctgtacacggcagagattttaaaatgttaatctcctatgactaatttcatttctaggaatttaccttaaaaatgtagatgtatgcagagagatttatgtacaacaatgctatcctaagagcaaaaattggaaagagcctgaacatctacaagtgagaggctaaataaatatggcatgcccacataatggaccatgatatgggcattaaaaatagtagttctgggaaatctctaggaattttggggaaaagaagaatcccaaactgtaaaaacgacagcatctaaacattcttgataatgtgcttggttgatttgcttctctgtctacacagcaccgcataagcacatcttctgaaagaccgaaagggaacagaaccagcaaacaaccattctcgcccagcccagccagagaggagtgtgtgactgcacttttctgccttttctttcttgccttcctgtaagaagcatgtttacttttacaattggtcgtgggtggaggcggggggcggatttaggaaaaggagctctcaaaactgagaggtgggtagaactttttcattaacaatggacttgatggcgatgaaagacggcttactcacccgtcgtatttgtctatgttaatctcatacagagtctccttggcctgattagcatgttcagtaactgtggggaaaaattacatcacacagtttatattcacatctgtgagtcctcacgtaaaaggcaaatcatccattcttttaaaatgagttcctgtaacaccttcaggcggatttcctagataaaattccctcttcaattctacatcgctcttatgggacgggatcaagctgacctcagggaacgtgaacatgaacctctctcgggccacagtctgcgcgatgacatgcagcgttcctggtatttaattgccggcaaataataatttctttgaaagagattacgtctcttttataatttttccttattatacaagttacttccaaaattgtacactataccaaagtgtagtaagaagatgttagtgcagtctctatacctgatgtaaacttctattgaaagtccccccaccccacaacaggccccggtgtgtgatgtgagattatttctaagacttattaatcctttgtgtctcctcttttgagaattttctgtccagaatcgttgcccttttatcttcctagtgtttttcttgattgccttctatgctgagaattggctggaaaatactaagttatttattttgtattcttcccattctggtatgtaaaaaaaagttctattttgtttaaaataatcttacaggataaaaatcttgggctgggcacagtggctcatgcctataatcccagcactttgggaggctaaggtgggcaacattgcttgagcccaggggttcgaaaccagcctaagcaatatggtgaaaccccgcctatacaaaaaatacaaaaattagccaggcatggtggcacaaggtgtggtgccagctacttgggaggctgaggcaggaggatcatctgagtcaaggaggctgaggttacagtgacccacaattgcaccactgcactccagcctgggcaacagagtgagacaccgtctagaaaaagcagaaacgtctctagtgactatacttgaatcattctcaaacttacttctacatagttaacatagaatttgttaccgatgatgtcagtggtgatggaggctaaggtgaacagtggtgccacttttctttcatatatccgcttgccttgtccttttcctccaaacgggttgataaataccagtaaatgctttggtctggacgctgtaagacaacaacatgtaaataacaacgaaaataacaaaatcaaaacgaagagctctgttactggacaaaatcaaaccatgagggttttagaattctgcttagtattacctgatggaaagtatttttaaatcttaaagaacaatgacaaagagcttcctgatctatgaaaagagaaaatcaacaggttgtccaactgggcaaaggctatacacacatgtcggacatcatgaaactcccacgaactcagaattccgactgagaagggctctctctgctctgaagggtgctgtcgggtacacatgctgggggcagcagcctcgttcttctgcaggtgaaggaggtgagtgtgcagacagcaggaagaaggaagcagacagagggaagagtcttaggaaaagcggaccagcaggtatggaaagaagaagccacacagggagatgcttgcagagatggaaagacagaaaccagtgacctcgtttccatctctccaggggccccgccaaactcccatgcctgggtttcctcagtcacccccattttcttttcttttctttttttttttttttgagatggagtctcgctctgtcgcccaggctggagtgcagtggtgtgatctcagctcactgcaagctctgcctcctgggttcatgccatcctcctgcctcagcctcctgagtagctgggactacaggcgcccgccaccacgcccggctaattttttgtattgttagtagagatggggtttcaccgtgttagccagagtcacccccattttcttataacaacttccacatttctgttttggtgggttcatgtgactctgctacttaaaagaacacatttaactaacaaatcaataaaagtaacaagacagtatctacccaaggaaactgaaaacctaagtccatacaaaaatccagacacagggccaggcgcggtggctcatgcctgtaatcccagcactttgggaggccgaggtgggcggatcacgaggtcaggagatcgggaccatcctggctaacacggtgaaatcccgtctctactaaaaaaaaatacaaaaaaattagccgggcgtggtggcgggcacctgtagtcccagctacttgggaggctgaggcaggagaatggcatgaacccgggaggcggagctggcagtgagccaaggtcgcgccactgcattccagcctgggcgacagagtgagacttcatctcaaaaaaaaaaaaaaaaaaaaacaaacaaacaaaaaaacacagacacaaatgttcatcacagcattcttcaccacagccaagcagtgggaacagcctgaacgcccatcacctgaagaagaaatcgagacgcagtccacacatcaacggagcatccttcagtcatgaaataagcaaactactgggtgcgaccaacatgaatcaatgtgaaaacagtatgcagagagactggaggcttccacccaggagcacacgtaaaacttctggggtgacagaagccttgatgggtttgagttacaaaggtatgtgtgtttcagaagtcattgattgaaacttaggattttggccaggcatagtggctgacacctgtaatcccaacactttgggaggccaaggcaggaggatcatatgagcacaggagttcaagaccagccagggcgatatagtgagactctgtctcgacaaacgatcaaaaaaaatcaggccaggctcagtggctcacgcctgttaatcccaacactttgggaggccgaggtgggcagatcacttgaggtcaggtgtttgaaaccagcctgggcaacatggtgaaaccctgtctctactaacaatacaaaaattagctgggaatggtggcaagcacctgtaattccagctgctcaggaggctgaggcaggagaatcacttgaacccaggaagtggaggttgcagtgagccaagatcgcgccattgcactccagcctgggtgacagagtaagactccatgtcaaaataaacaaacaaacaaacaaattagctgggtgtggtggtatgcccttgtagtcccagctactctggaggctgaggtgagagaatcacttgaacctgggaggtcgaggctgcagtgagctatggtcgtgccactgcactccagcctgggctacagagtgagacattactccagattctaccaatattacaaagaaaatgaaagaatttactaataagttcatgctaataaactcacgaatttggatgaaatggttaaacttctcaaaaagcaaaatttgtcagagataccagaagaaatagaaaatctgaatagtctgacagctaataaagacaccaaagctattaatgaaaacttctcacaaagaaaactccaagcccagatgatttcacaactgaattcttccaaacatttaaggaaaaaatagcctcaagattataggaacgcttccagagaacagaaaaaaacaaacacgtatgaactctttgtatgacacaccactgtgaccttgggaacaaaaccagacaaagatgttatcagaaaggggctcatattcagacatccctcccctgaacctacgtgcaaaaatcctaaacacaatatcggtaagtcaaatccagtgacacataaacagtactacatcacaaccaagagaggtttgtttactccaggactgcaacaatgagaaattaatgtaactcaacacattaattgaaaaaaaaaaagaaagtcatacagtcatctcaatagatgcagaaaaggcatttatcaaattaaatacccattctccacttaaaaaaaccaaaactctcagaaaagtaggattaaaaggaaattctgtcttaatctgatttttaaaatctattaaaaacataagaaacatcattcttaatggtgaaacactaaaatctttcccctgagatcaggactgagacaaggatgctgctagcacccctgtgttggtccaagccagggcaaaaacataaggaaaagaaataaaagagagaagaattaaaatggaagaaacacaactgttattatgcacagctgacatgatcgtgtttgacaaaaatctaaaataatcatcaaactattagcatccataagtgaagtttgcaaggtcattgaatgcaaggtgaaatacacaattctatcacatttctatacacaaacaataaaaaataaataaacagtgcagtagggaaaacgagactttcccgtaaatgccacagggtcaagcagatgtttatagttaatgaaaatactaggttgggcacagtggttcgtgcctgtagtcccagctacttgggaggctgaggcaggaggatcgcttgagcccactagttcaaggccacagtgagctatgatcgcatagctgcactgcagcctgggtgacagagcaagaccctgtcttaaaaaaatgaatacataaaaagaaagaggaaaatgaatcttgactgctcacctcacactggacacaaagatgaattccaaatggattacatagatccaaatgtgaagcggaaaacaatagagcttggagaataaaacgtcttcgtgactttggagtagacaaagatatcttcaataggacacaagcttaccagaaagttttttaaaatcataaaaataggccgagtatagtagctcaccctggtaatatcaatgctttgggaggctgaggtgggaggattctttgagcctaggagtttgagaccagcctgggcaacacagcaagaccccagctctatgaaaaaattttcaaaaaatcagccaggcacggtgacatgtgcctgtagtctcagctacttgcgaggctgaggcagaagcattgcttgagctcaggagttcaaagctgcagtgaaccgtgattgtgccactgcactccggcctgggtggcagaacaagacctcatctcccttttttttttttttttaaagatggagttttgctctttcgcccaggctggagtgaagttgcatgatctcgactcactgcaacctccacccccagggttcaagtgattctcctgcctcagcctctcgagtagctgggatgacaggtgtgtgccaccatgcttggctaagttttgtatttttagtagagatggggtttcaccatgttggccaggctggtcccgaactcttgacctcaggtgatccacccgcctcggcctcccaaagtgctaggattataggcgtgagccaccatgcccggccaagaccccgtctcttaaaaaaaaaaaatacgagattgaaaaggcaaattacagaattggtaattcttattaattacataaatttatgtaattaataaattcaataaaagattcagatccacaatatgtaaacagtttctacacatcattaagaaaaagatacaaccagctgggcatggtggctcatgcctataatcccagcactttgggaggctgaggcaggtagatcacttgaggccaagagttcaagatcagcctggccaatatagcaaaaccccctctctactaaaaaatacaaaaaaactagccaggcgtggtggcacacgcctgtagtcccagctactcaggaggctgaggattgcttgaacccaggaggcagaggttgcagtgagccaggatcgcgcaactgccctccagcctgggcaacagagcgagactctgtccccccaccaaaaaaaaaagaaaaaaagaatgaaagaaaggaaggaagagaaagataacaaccaaacggaaaaatggacaaaagacttgaacagaacctcacaaaaggcgatatctgaatggcccatgaacatatgaatgtgtttctcaacctcattaaccattagggagtgcaaactacaaccacagtgcaagactattaacaccaccatggctaagacgtaaaggtgtggctaagatgtggggcaaccagaactcccgaaccctgagggtggaatgcaggctggcagcgtcttctgaagtcaacacatgcaacaaacacctacaacccagcgactccattcccaggtatgcacccaggagaaatgcagacgggtgcaaaagacatgctctagaatgttcccaatgctactgttcatgacagcccacatcaggaagctgtccaaatgaccagccactgtaccatgggtgaataaatggccgtaacattcacatcacggaataccatacggcctagagaatggacaaacggcagccccacgcgagagcgtggaaaatttatgcaagactactcgccaccacggtggaaaacagcgtggaaaacttcacaagtgtcatgttgagccgagagccaggcacaaaaggtttcatactgtatgatctgatttctatcaagtacaacagtgaacctagttgtttagaagtcgcagcagtggttcccctttggggagtcatgaccacaggggcacggtgggggaccctggggctggcaatattctgctcctttatctgggtgctggttacacaagtgtgctcagcgtgaaaattcacccagtgcacactcagaatgagatcctctgggtctgtgatatgacaaatactaaaacagcctgtaatcccagcactttgggaggccgaggtaggcggatcacttgaggtcaggagttcgagaccagtctggccaacacggcgaaactctgtctctacaacaaatacaaaaattagccaggtgtggtaatgggtgcctataatctcagctacttaggaggctgagacaggagaatcgcttgaacccaggaggagtttgcagtaagccgagattgcaccactgcactccagcccggatgatggagtgagattgtctcaaaaaccaagaacaaaacaaagaaaaaaacccactaaaacagataacagggttagaagttaaaattgtagagtagctgaaacaatagaatcatatacaatttttagctacaaggagactatatcaaatgcacaattataaagatgaaaatgaacccacattctccagtgggaggcagggttcagaggactttctcttggagtctgcacctataggatcaggtctggaatccagtcagccaaagtctcatgaaaacaggtttgatgggaggaaagggaaggagaaagcaggacggacggaaagggggagtcgagagacaaacagaggaggggaaggcgggagaaacagatgcactcttctgaacagcctagtgcggaacgacatgcagaggaacggggcttgtggtggtttgagatgtgaggacggtcaggatgagcttttcacgacagcaggtggtggaggccaagtcccccaggattaaacagggaagtatggaagcacaggccctcctgccccagttgtaatcaagaggagggctccttcaagcaatgatgctgctctgaagcagatatatgggaatgcctccttttaataaactgaaattcactttcttgatgtaggtgccaaattcattcaaaaatatataaaactaacctaaacacatgccatttctattctatgggtgaagcctgtgctgagttgtcaagactgtgtattggctgggctcagtggcttacacctgtaatcctagcactttgggaggctaaggtaggaagatggcttgagcacaggagtttgagatcagcctgggcaatatggcaaaaccctgtctgtacaaaaaaaattagccaggcgtggtggcacacacctgtagtcccagctactcaggagactgaggtgggaagatcacttgagcccggaaggtagaggctgcagtgagctaagatcatgccactgcactccaccccgggtgacagagcgagaccctgtctcaaaaaaaattgcctattaaggttataagcaaacaacatgaaatagtgttatgaatacaaaatgaatgaacacctaccactttgtgtgtgtgtgtgtgtgtgtgtgtctaccatatgttcctttttttaaacttttaagttcacgggtacatgtgcaggtttgttatataggtaaagtgcgtgtcatgggggtttggtgtacagattatgtctctagccatcctaccactttttaagggtgacaaagtcttgttactcagcatgcaataactaacccaccaggctccaggctcctactacatttcagatgtggacacatccctggctgggcgtggtggctcacacctgtaatcccagcactccaggaggccaaggtggggagatcacctgaggtcagaagtctgagaccagcctggccaacttggtaaaaccccatctctactaaaaatacaaaaattagccaggcgtggtggcgcatgcctgtagtcccagctactcgggaggctgaggcagaagaatcacttgaacccaggaggtggtggttgcagtgagctgagatcgcgccactgaactccagcctgagcaaccaagcaagactccatcttgaaaaagaaaagaaaagaaaagaaaaaagacatggacgcatcccagacagatgtgaggtgtattcctccatgtgcccagtttaattctcacattcacctcgaatgtaaaagctattaccatctccgcttccagaaagagaaactgaggctcagaagggtaagtgacccgcccccaggcctcctggccagtgagcagggggctggactccatgccagggtccaggctgtggagcccatgccctttgcattcactgggatggtctgctcatgagaaattaagtcagcctgactcatcatgtccacctggggtatggccagctgcacgaaacggggagacacttcaggaagatcacccaatcaggcatgcgcatgccaccacggccatcctgtctctcagtccaaacacacacgtactcagcttctccagcatctcccgcagggtctgcagccacaagtgacacagctgctcctctggacaccagaaagtcacctgcgcccacttccagcggtgccgtcgtgctctctttacacagtgaactgcacagaagcaagcatgctcgttagtgcaaagtttgcagggtcactgacaaaacctcaagtgaatatgcaccaaatgcagctaattataggttcctaaccaaaatttcccaggggttctcctcccttctaattagtaactttcaaggtatattagaaaaaaacatccgatctttcaaaccttttaagtcatataagggaaaagggctggctgtgatgactcacgcctgtaatccagcactttgggaggctgaggcgggcagatcacctgaggtcaggagttcaagaccagcctggccaacatggtgaaaccccgtctttacttaaaatacaaaaaagtagccgggtgtggtggcgggcacctataatcccagctactcaggaggctgaggcaggagaattgcttgaacccaggaagcagaggttgaactagccgagaccgcgccactgcacttcagcttgggcaacaagagcaaaactctgtctcaaaaaaataaataaataaaaataaggggaaaaatgaccattaactaaaacattaactaaaggtagcatttggggaaaaaaataggaagatttcataaagataaaccaatgcattgagcttgttaaacaagtaacagaaaagttccctctcgtgtaatctacatagaattaatgaagaatgtgggagaagacatttaggcttatcacctgtaaaagcgtaaggcttttccattttctgccattttccactgccttgatgtttcccgtgaacgtctgtttcctcaacggcgatgatctcagatacaggcacagagcaggcatctgtaaaaacaccacgtccttctgtcaaagaattcgtcagaatccacacaggtaaaatcagtccaactccaagaagctgagaatattctgctttaatattctcattagaaattcaggctgggtgtggtggtgtgcacctgtaatcccagcactttgggaggctgaggagggaggatcgcttgagctcaggagttgcagtgggctatgatggtgacactgcactccagccctggcaacagcacaagaccccatctccaaaaagaaaaaagatatacatatatatatatatttttttgagacagagtctcacgctgtcgcccaggctggagtgcagtggttcgatctcggctcactgcaagctctgcctcccgggttcgcgccattctcctgcctcagcctcccgaacagcttttttaataccccctcccccaaaaaggaaggttataggtcacttttaaactcacaaataaataactgtgggcagctcaatgttaccagacggcgggatgttttattcagccgagtcaccaaatggaggctgtgatttttcacacgatttgctcacccattcaagcagcaaatgcggaccattccgggccagctaccatgtgaaatttggggaaacatgctcgagacatggcctctgtctgcaggacagtgcctggttcagaaatccaagtgggagggagacacgtgacaggacccgggacagctggaaccacggagcttgcaagtgaggcagagcccaagtgtggcgcgaactggagtgcagggggaggagacaggggagacttccaggggcccaggggatgacagcaccggacatgctccaccctgggaaccagcaaggacccattccacccgagccacctggggcgtgttcatctgctgggcagctgtaattacaggcttgcacatcaaagaaagttctgggctggcagcagagctgtgggaggtgacgggtaactgaagtccaaggcctgaaagaacttgcccaggagagcatgggattgaagacagcaaagccaagtttgaggaaggtggcttccaaaagcttattctggaattactgttaggcatgtatgatatatccttacacagaagaatgttataatttgtggttagcttcctaggttggctataaaacctgcaatatagctaaaataccgtatttttgccgtagctaaatgcaaaaaaaattgctataacatttgtggtaattttgcatcatttttaaagttgtggcccatggaaatcaagttctaggaacctgggagggtagtgtctgaactgggcctttgagcactgtagaaacctttgaaaggccagtagtggggcctcctgattccctctgaagtgaagccagccccaggggagcagacttgatggggagggggtgggttacagaggatgaagtctggctggagagcagaggtctcaggaggtgtctgtgtgcatcctcctcctgggtataggatgtggggtccagagtgactctcagggtccccaccctccggtgtgccccacctgggcctcccatcttttttttttttttttttttgagatgcagttttgctcctgctgcccagactggagggcaatagctccatctcggctcaccgcaacctccacctcccggttcaagcgattctccctcctcagcctcccaagtagctgagattacaggttcccaccaccaggtccagctgatttttgtatttttagtagagacagggttttgccatgttagccaggctgcaggccgtgccgtgccaggggtgccagcacaagaccaggcagtccacgtgcgtcctgccagaaggagcgacacaggtgctggggcagggaggtggtggggacagcctcactgtcagggtcagggttcagaggattccccgtgggtggaggaaggcgacgtaggggcaggagctggggagaggcagaggccgctgggaaggaaagggcgagcggctgcgagagggtggccactctgggtggagggataaggatcccacttgggtatgactctgaatagctacaagtgttcgggacagggcaagagactgaacaggaccaaggacgccctggggtgaatccaggcaccttctgccacactggacctgcagcaaggtgtacctgctcctctggcaagagaaaaagacaaagatgccagcagggtcattagtttacacacgttccttttacacacagattaataaatggaattattgtctctaaaaagggacagaaaagttaatagaggaacaaaattcaatattgtctgcacagctttattgaggaacgtcaagaataagaacacagggcggacacagtggctcacgcctgtaatcccagcactttgggaggccgaggcaggcagagcacttcgggtcaggagttcgagaccagcctggccaacatggtgaaaccccgtctctactaaaaatacaaaagttagccaggtgtggtggtgtgtgcctgtaatcccagctactcaggagattgaagcatgagagttgcttgaacccgggaggcggaggttgccgtgagccgagatcacaccagtgcactccagcctgggcaacaaagtgagactcagtctcaggaaaacaaaaaaagaagaagaagaatatagctgacctctgaacaacatgggcttaaccttcaagggtccactaatgtggggttttcttcttttttttttgtttttgaaatggagtcttgctcgtcacccaggtgtggtgtgatcttggctcgctgcaacctccgcttcccaggttcaagtgattctcctgcctcagcctcctgagtagctgggattataggcgcctgccaccgcacccggctaacttttgtacttttagtagagacgggatttcaccatgttggccaggatggtcttgaactcctgacctcaggtgatctgcccgcctcggcctcccacagtactgggattacaggcatgagccaccgcgcctggccagatttttcaataaaagtgacactaagctcacttgcctctcttgcctccccttccacctcctccgtcttctccacctccaccaccgctaagacagcacgactgatccctcctctcctcttcctcctcagcccactcaacatgaagaccatgaggatggagacctttgtaatgatccacttccacttaccagatagtaaacacattttctcttccttatggttttcttaaccacgttttcttttctctagcttattttattgtaataatacagcatataaatcaggccacataggaaatatgtgttcatcggctatttacattatcgcaaggcgtccagtcaacagtaggctgttagtagttaagtgctgggggagtcaaaagttttcaactgtgtggggctggggcgctaacccccatgttgtttgagggtcaatctgcactgggtgcggctcaggacaagggcttccttgctgactcaggagacctggagtggtgcggccatggtgggaacacattccccaggtggcaatgagtggctggacttggcgtggctttggcctgtatctggctgcagtcttactgtgggtaagccgctaagcctggagcatggtgtaaagggggtggagcgatgaaccccataggggattagaaactggaataagataaagggtgaaaaagtttcaagcacaaaaatgtccgataaatgatggcttcctttcttgccaaaaaggctgggctcagcagggcggggtggctcacacctgtaatccctgcactttgggaggctaaggtgggcggatcacgaggtcaggagatcgagaccaccctggctaacatggtgaaaccccgactctactaaaaatacacaaaaaattagccgggtgtggtggcgggcacctgtagccccagctactcaggaggctgaggcaggagaatggcatgaaccagggaggcggggcttgcagtgagccaagattgcgccactgcactccagcctgggcgaaagacagcaaaactccatctcaaaaaaaaaagaaaaagaaggctgggctcaagatggaggctctgcctccttcctccttcaggccattgtccctgtgttaagctgaggactccacagtgagagaactccacagtgagacgcctccagcctagcagcacttaccccttctcctgctctcctcacctcggtgtgtcatcggcattacgccctagtcttcgatactctcatttctaattaggagataaagaaccgggccaagaatctgagcaaacggagagcagctccctgcgggggctcaggaaacacttgccagcgtccaccggttggagagctggcgcctgctcatctgagggcaggtcatgtggacggcagtgggaccaccgagggctggcacacagaagaatgcggacggtcctctagaagcagaaggaactgccctctgagggttagtctcaaattgccggcaccaagcagcatccccgcacagcacgtggtgtgtggacatgccacagcatccgcgggagaaaacacacctgacccaggtggacagatgctgtgggaacatcttgcaaagggcggaaggtgggaattgggggcactttcatattcttttgctgacagagataaattctcgtgacagaattctcgtgagacaccacagtgactcgtattgacatgcagtgagctcttcaatagaggtaatgatcaaatggccatcacattccagaaaaatcaaatgccatgtcagcgagtgaggctggcctcctggttctcgtgcggctcacgcgtttgctgactccctctctgcagaccactgcagcatttgccacagtctgggtaatgcctgctaggggcagctgagagcacgctgacttccagctgcttctttttccattctgttctctgtgctttttagtgcttgttgtgatccactagaattaaatttatttcatgcttgtgacttacagatgaaaacagtgcctgctgtcaatcagctttgatactagaagttcccggattaaactgagccacgcgcagtggcctcccatccagcaggagggcccacgggtttcccgtgtgtcacggggcactgagtgtctgccagtgacatgggtgcacgtgtgtgggcacgctcatggcagggcagggtcaaggtggcagaacatgccgctccagacctcacgcagccgtcgggaggccccagatgtctttcgcctcttgggcatatgcaacgagaacaagagcgagttcccagctaagagcacaggggagcacagcggtccctgggactctccctaatgcaagctgccacgtgaggaccggcagagggaacagggtgagagagcaggccgctgcccactgcgcccactggagcagtgccaagtacagtgtggaagtctgtggatcacacccacacacactgcaggggatgctgaggcccagaagtggcacgggccacactgacctccacatgcccggcccgcttagagtccaagcagtaagggtcaccccagaggaagaacacccaagagatccgagtggctgggaggcctgattccccctgcaatgacatgcaatgcaaacgcatttccctggcaacccgccgctcagtaaacatgagctgtgtgaacatctgatcttcattaaaaattaaaggtgagtgcttgcctatgccaaggaagaccaaaaaccagccctgcccaccactgccagggagagtccagaaatctcacgtgcaggaaactcagagatggtcaaactgtcccccgcccctccccgcccaccacgtccaccctgacacagcccttgatgggtctgatacacagatggaaggtgggggaagccagaacccacgtgacgcccacaggtcagccctgagctgcgacttatccagacgcgactgcgtgtccccagcccttgcctccgctgcggctgctgctgtcatacagggatgcgcccaagtttcgtcttttatgggaaaccttctgattgtaaaacattagctacaattttaaaaggaagagaaaaactcaccatgcaaatctaacaaagaaaaaaatctgtggccaaatttagcccaaagacctctgctctgcaacccagtgaggctgagccgtggtttttctgaccgcacggatgatgaagaaaatctcacagcaagcccccagagttcatgatgctgggataaggtacctgccaatcataacttactgctatttcatgccataaaatgtgacctttgacccttgtcagcacaccattagtagccaccaatgtctcctcttctttttttttttgagacaggtctcactgtgtcacccaggctggagtacaggggtgcaatctcagctcactgcagcctcgacctcccaggctcatgcaatcctcccacctcagcttcccaagtagttgggaccacaggtgtgtgccaccatgcccagctgtttctttttttttttttttttgagagatggggtctctctgtgttgccctcagagacctggttggtctctctaactcctgggctcaagcgatccatccactcagcctcccaaagtgttgggattacaggcgtgagccactgtgcccagtcttcttagttctagggacacatctcaagtaaacagtgtccattccctgtggaacccaccccagaaatccttcctcgtcctaacgtcccgataccagcctaagggtgctgtggtccgcgtgccccactctcaggcaggggcctggtcagcatcccacaggaccacccggtgaccacccaaggtccatgggcttctgaacatcctgcacatgccgccccaacactcccctggcccagccaccccccccggccctgccacccccgcggctccttagcatggatgctcccttagcatgcacaggaggcctggacctgaggatgccaaatcattcctctcaggaaacagggctgtggcatgtggacgggcatgtcacctgcacagcccacgtggcagccaacacacaggactttgcttttcctgttaagccaggaggttctggagggcagggtggaattacacacctgcgcagcccctgtgtgtgggttcaggaaatgaatcagactaatcctagacctgcttagacgacacccgcagaactgaagtccataccagctggcatctcaacacagaacacccgccgtccccactccatgctgtcaggtcgcgggaaacctgcatcagcctcccgtcctagggatgagacggggtgtccaagggctccagggaccgtacggtgcctcagggaactttgtcatgggaactggactgattttgctccaggaaccccgctcttccccccgtgcaccctgctatgaaaggccacgggggctacttaaacaaatcccagagtccctgcctttgaagagggagctcaccccagattctggagcagcctcgctctgagtccccactccccaacctgtgagctcagctctaagtcccacatctccacctctgagaagataacaaggggcgtctcagagggctatgaggatcccattgggtgtgaagcccgcagcactgcagggcacagtacacgctggcctaaatggaaagcagcattcagacatctagttctggccagaatgaaccaagcccgaccgcctgtctctcccacccgctatgactgatagctctggacaagatacaagaaacaggcagtgaaccggggacaccagagatccacagcagcaggcccgctggctggagaggccagcgtgcagagtcagcagctgggagctgggtttatctccagctctggcctcggggacgtctgagctatggggcagcagggtgggtgcaggcccctgtcccagagaagccagggtgtgctgagggcagaggggtgctcagaggagagggggctggagcaggaatacttggctctgagaatgaccagatgagtccagcctcactcctgaggggccaaaacagggcagccagggcctcggaggctggacagccagggcccacctccctcgccacatgagacagacctgccatctgtacccagccaggctgagcacctgcttttgaaaaagaaaaattggctgggtctggtgtctcatgcctgtaattccagcactttgggaggctgaagcgggaggactgcttgaggccagaagattgagaccaacctggacaacatagtgaggccctgtctctacaaaataaattttaaaaattagggagaatgatggtacatgcctgtagttccagctacttgagaggctgaggtaggaggacggcttgtgctcaagaggctgcagtgagccaaaactgagccactgcactccagcctgggaaacagtgagactgtaaataaataaattaattaatttaattaaatagaaaaattgtccaaatgactttattttttattaattttttttaagagacagggtcttgctctgtcactcaggatggagtacagtggtacaatcatggaacaccgtaacctcgaattcctggtgtcaaatgctcctcctgccccagcctcctgagtagctgggactacaggcatgcacaacacccagcctccaaaaaacattaacaggacttggccttacaaaataatgtaccaaatatccaggaaacaacccacaataaatcagcacaccaagaaccaggaaatgttaacgttctcaagggaataatcaaaagacgtcaaacctgagatgacccagatgttgatgttatcagacaaagacttcaaagtagtctttggccaggcgcggtggctcatgcctgtaatcccagcattttgggaggccgaggcaggtgaatcacgagggcaggagatcgagaccatcctggctaacacggtgaaaccctgtccctactaaaaatacaaaaaattagccaggcgtggtggcaggcgcctgtagtcccagctactcaggaggctgaggcaggagaatggcgtgaacctgggaggcggagcttgcagtgagccaagatcgcaccactgcactccagcctgggtgacagatcgagactccatctcaaaacaaacaaacaaacaaacaaacaaaaaacaaagcagctgttataaccatgctcactgagacacagttgaacatacttgaagttttcaggaaagaggctgggagtggtggctcacgcctgtaatcctagcactttgggaggccaaggcgggcagattgcctgagctcaggagttcaagaccagcctgggtaacatggcaaatccctgtctctactaaaaaaaaaaaaaaaaatagccaggcatggtggcaggcacctgtaatcccagctactcagaaggctgaggcacgagaactgcttgaacccaggaggtggagtttgcagtgagtcgagatcacaccattacactccagtctgggtaacagagtgacagtctatctcaaaaaaaaaagaagttttcaggaaagaaatggaaactattggaaccaaaaggaaaaatttaaaactggaaagtacagtatctgaaatttaaaaatcaccagataggcttagcagcagaatgaattagatagaggaatagtgaagttgaaaataggtcagcagaaagaatctattctaaagagcagagagaaagaaattgttttaatgcacaagcaccttctgcttctgggaggatggattagctgtgcttttcctactcctcctattaagtgaagccctggacgtcacacatgaaacaaatataagaagactctgacaggcagagaaaaggcagctgttcagggcctgggatctgagaaagacacacggcatccccctgggggtttcctttgcctcgtctatcttggatttggaactggagcagcctgaaacctggaaatgccaacaggtacaaacgcagagccccagtgaaagccaactcagtctagccagggaaggggcagctttgcaagacagaaaactttgagacaataacaacctaccccagaaaaaaacgggcccagccctccaaccaagcccaagtggccaactagcagcttagacttccacccttgagaggctgtgagcaggcaccccacaacctctgccagggctgtacaggggaggccacgcaggaagctggaacccccatcagcgccagctggtaaaaagcctcatgcccactaggcattggtggagacaaaggggcagcccagcccgggcccccaccctgcactggcgaggtgccccttcctccttgctggagtggagtaagaggaggcctggtggggagacagggctttcactgccactgagctgcaaggtgcccacactccacccacgtgctgttaggggagtgcatgtggggagcggcaaggaagcacctccaccccccgccaaggtggccttagcagaggcctggcgggagctgtaccccccacccacccggcaatgacaagcagcccctgactccgctgccaacaaggctgaggggaacctgggcttccacccccacctggcagtaccagcgccgttccctgctggagcagtgccagagaaaccagctaaacagaaggtgtaaacgctgcccagtcttggaacatactgcaaaataaccagtgctaggtgagtctgggaaggagggctgggccttggtgaggctgaggatagaggaaaacatgtcaggcagggagggcagagggcacctggggaggcacagggcatgcgggagataatgacggctgggctggtgagcacgtgtgccccgggagcaggtgggggcagggccagatcgggggaggtcaggaatgcaagccaggccacaggcacgcatgggcgagcagtgcctggaagaactttgtagcagggcagggtgtctaaacatcaatggggcacacaggctggctgtcaggacgggccaacggcactggagaagggattagtgaccctcagggtgctctctaaacttccaatccccatcatccagggttcagccgccggggtgctccctaaagaaattcaaaaggcagcaggaggggtcgggaggggaagaccggggccagctggaggcagaagtcatctgacccagtctgtggcaaaaaggggaccaaggtcagcgagaaaggagagaagaggtatgggatccggacagccgaatcgagaacccagcagacgtgtgggatccggacagccgaatcgagaacccagcaggcggtgagggtgggccactggcctaggagagaggccgagtagctggagcttgtatgcgggtgacaggctggctgtctccaggacagaggagaactcgtgcctggaagtccacgctgggctaatcgctgaagccattaagttgagatgcatcctggaccagctacaggttcctgagataaccctcaaaaggcaggactcagctgcatttctcatagaaaacgctgttatgcaaaaatctagactgttagagaagaaaaataaattgggtgggggggacgggaagtaaaacacattaggagtttcttaaacacacagaaagtgtatcttctcgagtatgaaagtttcttaaatactggtggtttaatttctctgggatagataatcaaaaatggaattgttgggtcaaaggatatcactttttttttttttttttacagtttgaaaacactgccagattactttccaaaaacaccctagcagttcccacttcccattcaccgggtctgccagcccagaagcgtcctgaaacttccccagcacagagctgtgctttcgcccttccccatcccttgctggttgagagcagcatctcatcattgccttgggtcagtatctactcagacgctcagcatccacttccgaatgttttcttccgtgaatcgcctacttatatccattgccatttgtctaatggattgtctgccttttttcctatcaatttttatgtaagtttaaaatgttcaaaaaatgttaacctggccaggcgcggtggctcacgcctgtaatcccagcacttaaggaggccaaagagggaggatcacgaggtcaggagattgagaccatcctggctaacacagtgaaaccccatctcttctaaaaatacaaaaaattagccgggtgcaatggtgggtgcctgtagtcccagctactcgggaggctgaggcaggtgaatggtgtgaacccgggaggcggagcttgcagtgagctgagatcacgccactgcactccagccctgggcgacagagtgggactctgtctcaaaaaaaaaaaaaaaaaaaaaattaaccctttctctatcctatttgttgcaaatatcacccccatcattttttatttttattttattattattattattatttgagatggagtctcgccgtgttgcccaggctggagtgcagtggtgcaatcacagctcactgcaacctccgcctcccaggttcaagagattctcgtgcctcagcctcctgagaggctgggattataggcgcacgccaacatgcctggctaatttttgtatttttagtagagacagggtttcaccatgttgggcaggctggtcacgacctcctgacatcaagtgatccacccgcctcggcctcccaaagtgctgggattacaggtgtgagccaccacgcccggcccttatctttttttttaaatttatgatatcttacaaaagaaattttaaaattatttcgtcaaataatctagctttttctttattctttctggattccatcttggttaggagagccttttcccattccaatattataaactgtcctctattttcttgtaagaatttacagccaggtgcagtggctaacgcctgtaatcccaacactttgggaggccgaggcaggcagatcatctgaggtcaggagttcgagactagcctggccaacatggtgaaaccctgtctctactaaaaatacaaaaattagctggtggcaggtgcccataatcccagctactcaggaggctaaggcaggagaatcacttgaacccgggaggtggaggttgcagtgagccgagaccttgccacttcactccagcctgggaaacagaggaagactccaaaaatataataaaatatgttatatatacatacatacatatatatatatatatatatacattttcctataatccagctttctactcttaaatatgcacccaagaggagcaaaagcatagcccctaaagggtcagggtgtctttatccacatagtcaaggtgaatggactgcaaactgtccagaagcccatcagcaggtgaacggatacactagtgcacccacacaatgcaatatgacttagtaaccagaaagaaggaactgctgacatgatgaatcttaaaaaaaacaaaatgagataaagcagccgggcacaaagacgtgcacatggcatgattccatttacatgagataaagcagccgggcacaaagacgtgcacatggcatgattccatttacatgagataaagcagccgggcacaaagacgtgcacatggcatgattccatttacatgaaactctattagcatcgtgcctgtccctggtgagaaaacagcccagggcccaggagaaggtgctgggctgctgcgatccgggtgatgtttacacaggtgcacacaattatcaaaatttaaccaactatgtgccttaaaatgtctgagttttattgcatgcaatttagaccttgataaaatcgatttttaaaaatcatgtcttaggagaggaattagtagcgtggaaaacactctgcagtatgttttctcagcttttctttcatgcatatttacatatacacaaataccaaatattaatcacgtctaagtcgaagagtgactttttgtgtatgcttttctgtgttttctcgatattattaaatcaacatgacttacttttgtaagcaggaaaaacatttttttaaagtatctgtggcatgcctatgttttgccaggcactttgcagggtgtgctgaggacacgctttataaacacagtactgacctgcccaacgagttcaccaccagcctgggacatcccaagtggggttggtggaaggaaggggaggatcctcccacaaaggtagagcctgggcagtagtcccctcaccccccaacacacacacacacacacacacactcttcccattcccaactctaaaggaataaatgcagggtttgtctaagtgtgttttgcgacagtcaggggaaataacccagatatcaactcagtgtttccagttcaacgagcatgacccacttcaagttcctgttttcgtcctgccctacttcccaccaggctggcggcccagggcacttgctgtcgcggcttcctcaggtgcagacctcacccaggcccaggaagctgcagcgatccaaattgctagtccttgtctgtgctcttgtacagtcagtcactgtcccagcatgatgacccactgacgaaagtgcacgtgcctgggttcaaagccagctccctctgtacatcactgcctctgggcccagtcaattcccactcctactgtccacatctgaaataggggtgatgctacggagaaaacaaaggagtcggaataactaagcggccaccccagcagggcacacacagtggccttggctttgtctttagcccattggtcacctggagctccagggctgctcctgcctcatctcacaggtcctcctagggccagtttttgcacaattctccacctctcatcattcctcaacctaatcaatcccagtgtgcccagatacacctgggggaatggggagggctgggcaatgccaccttgctgaccaaattaaatgtcctgtgagctggttcacattcttctgccctactatggccctactgacctcaagcatagaagaatcgaacctgggcctgattccttttggggactgtaaagctatgagaaaaaaactagagacagtgtggctgtattcctgaactcattcacaacttagcgtttcccaacttgttgatgttttcccattgcatgggagagcactcctgggtggagagggcaggctgcttcctggaggaagcccaccagccagggccaccagccagggccccaccatccatggccccacaaaccagggccctccctctccaagagggaccaagctcctggcaggccagtcaggcagctcaggatgaacccgcacaaaagcaccttggcttagcaagagtgaagcaattagcatgccaagaggcaaaccccagcaggctggacaaaagcagacgccacaccacaccaagccctgacctgggggaccagaaaccataatgggagctggctggggacgccaaggcagaaagcagtgatgactgacctcccacacagatgccctgtaagggtctggcgtctctgcggcggctggagcctgagggaagccttacagcccagtggctacaagcacagcagctaattgggccagtcacttccagcccctgcagatcggcccctgcatccctaggacgggagcagctgcctctcaggaacccatccggtttgaagcccagtggcccgcacttaggaagtgcttgggggaggcagtcatcttcctgaagcctagggatttacaacaaagtacaaacccttcgggcccaggtcaggcacctgttctccttgtgtgtgggccctggtgggtgatatttggggtgtgacatttctaccaaaggggacatgagaaataccttaggaaagtcaagtctcagatgcccagccacagataggtgaccccagggctggaaaccaagtgttggtcatgggtctgagaccacccctcgaccttggccccacctaacgttcaactctgtccccaccagaacccaacccacagatcctcaccactcagcaccagaaagcgcccagaagaactcctgacctcgactgcccacagggtctaaaggtgtcatcccaggctccgaatatccaccagagaatcttggcctccgccacacccaccccattccagctccgcacatccagcatgaatcctggcctctgccacacccaccccaataattaaaaagaaaaaaggctgggtgcggttgctcacacctgtaatcccagcactttgagaggctgaggtgggcagatcacctgaggtcaggaattcaagaccagcctggccaacatggtgaaaccctgtctctactaaaatacaaaaattagccgggcgtagtagcgggctcctgtaatcccagctactccgaggctgaggcagggagaattgcttgaacccaggaggcggaggtgcagtgagccaagatcgtggcattgaactccagcctgggcaacagagcaacactccgactcaaaaaaaaaaaaaaacaaaaaacaaacaaaaaacaacaaaaaacaaaaacaaaccctctgtcctcctgcagggctctctccagggtgggctatgcgtcctccatgtttaccaaagtcactcttctcctcatccggagggcctctgcggggcaagtagccaacccgtggcacggaaaccaattcccccatcccgagcagggagcacaccccacagaaagtcaggggccccttctttaacttcttaacaggaagtcctcaccctgcaagggcgcctctcaggtttcggatccctgctaaagaaaagcatctgttcttggagtaaactgcaatgcgcgcggtggggagcgcctggcaccccccctcgggatccatccacagtccgtcttgtccagaggtgccctgcggacagaccgcaccgggggccacgaccccgcgccccgggtcccacctccccgcggggatggggcgccggcctcccctccactgcgcggcgctttgtcctcgggttcccggagcagacggcggcgcacagcccggcccctggccccggcctccctcccgcctgccccgacccctccctggcgcctgcgctcccagggcccccggccttaccacagccgctcgctccctgcacccggtccccccagccgggtcccccaagccgcccccgctccctggccaggtccggccgaacccgggcggcggcgacactcacccgcgccgggggcgccggctccgggccccgggctccgccaccagcgcagcagagcccgcgcgggctccaggctcacggcgcagcgctgctgcttcacccacagcacggattgcagcggctccgccgcccccgtcgcccccatctccgccgccgggctcgtccgccaggctgggggcgcgcggacgccgaggggcgccggaccgttagcggcccctgcagtggcccgggcggcgggcggcgggcggcggg

SEQ ID NO: 2194 - DNA, 9968 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacctcaatacaccctggctgcgggaagctgggccgggcgcccgggggctgcgcggaggagggggaggcgcctccctcaagggctcagatctactgactatcccgacttactgcgctgagcgggtggtttacagcgagctctgtgtggtatttcagtccctactttaacttagtcctagagtttttggtgaaaatctgcagggccgggagccagggtactctcgttcagtggctcctgtttagtccacggcaaaggtgggacggagtggaagaacgcacagcccccagcagaagcattaccttccacttaagggtgggtgcatcagggctttagaag

SEQ ID NO: 2195 - DNA, 9635 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacc

SEQ ID NO: 2196 - DNA, 96271 bp, Homo sapiens
cacgggcggccggatttgcccggaggccgcacccgcctccggcggggctctcaggtatgtgcgccgcgggggtccctcaggggggttgggggtagcccagggaggtcggggtcgggggctggcctctgtagggcgctcagaggccgagtccccccgagcgccgcgtgggtgaggcttggcggtctggtcggggaccgggtcatgtgagtcacgggcgcccctcctttccgcccgcgcgccctcggaacgggcggcccaccctggcctgtcctctggcggcctcaggccggggccgggcgtgcaggggctgacacgtgggcaggaaagcgaggcagagccgccgccgcgtaaggccgggctgagggctcggcgtcaccagccagggctgcagagagcggcgtggcacccggagttggattatgcgtggctggcgtgagctggaagggagtcactcgcccacaagctctcaccacgcgagcttttattgtcccgttcaactgctccgcagtgtggagatcgcatagttacgcacgtcgtggttgtgtcgccccacagtactgactgcttcacctttgcagacagaggctccggcccggcgcggtggctcacgcctttagtcctagcactttgggaggtcgaggctggaggatggcttgagcccaggagttcgaggctgcagtgagctacgatagctccactgcaccccagcctgggcaacagagggagaccctatctccctctgaaatagtctaaaataaggaaactagaaatgcgataatgcccccaggaaattctttctcaggaatatatgtatttgttaaatggttcagtatatgatttattttttattttatttatttatttgagatggaatcttgctctgtcgcccaggcgggagtgtagtggcaccatctcggctcactgcagcttccacctccctgggttcgttctagcgattctcctgcctcagcctcggggtagctgggattacaggcccgcgccaccacgcccggctaatttttgcatttttagtagagacggggtttcgctgtgctggccaggctggtctccaacgcctgacctcaagtgatccgcccgcctaggcctcccagaatgctgggattacagacgtgagccaccgcgcctggcctcagtatatgatttataagctttatgctgtatgagggttcagttatgtatttatacatacttgataggaaatgctaaagttcacattcctatggatagcttttggtgcttttcaaactaacgaggctggcacggtggctcacgcctgtaatcccagcactttgggggccaaagcaggctgatcgcttgaggccaggagttcaagaccagcctgggctcgtctctataaaaagaaaataaaaaataaagctctaatgacagtcattaaaactagctgccaaacaccacattactagcgttagcggtctcagtgtacttgggtggttttaaaatgacacccattggacctgcaaaacgatggtgcttcccgatatgttcatgttattcatcttttagaatatggaagagaaagttcttagttctcgaaatattgtgtaaaatataaggtgacaacctggatctgttaaatgacattcatctaagtgtactctcaaagtcaaaattatcttttcatacaggtggaacttatattttaccttacttgctaaataagtcattgtcattaattgtatttgcactgtgtttttcagtgaaaaatgtactctgacctgaatcctgaattttccttgatggtcaaaagattaaggtatcaaatttccttttttctggatgtattatcgttttactctcttacattgcaatcccccactcctgcaaaaaacccacggagtttcagaataaaatgattagcatcagtaaacatggaaatatttttctttttggattaaattatttgtttatgttctgaggaaaaatctttaaaagcttagttttattgtttttgttgttctttataaccttagccttcagaaaaataaatgtttaactttgcttcttctgtgacttgttcacctgaattcaagaaggtggaattgggcctaaggaggtggctcacgcctgtaatcccagcactttaggaggctaaagtgggcggatcacttgaggtcaggagttcgagaccagcctgggcaacacagtgaaaccttgtctctactaaaaatacaaaaataagccaagcgtggtggggggcctacaaaaattagccaggcgtggtggcggggagggggttgggcagtgcttgtagttccagctacttgggagaaccacttgaaccagggagagaggttgcagtgagccgagatcgtgccattgcactccagcctgggcaacagagcgagtcttcatctcaaaaaaggaaaggcagaattgaagaagctttggaagaggtgaggaatagagctgtggaaattactattttttttttaattgagaatctcctgtgtgtaggtgccttacaaactggcttcatgagtaccctataaaacagatgtttttatttttaaaatcatcatggttttgttttgttttgtttttttgagacagtcttgctctgttgcccatgctggagtgcagtggtgcaatctcagctcactgcagcctctgcctcccaggttccagtgattctcctgcctcagcctcccgagcagctgggattacaggcgcccgccaccatgccaggctaatttttttgtatttttaatagagacgaagttccacagtgttggccaggctgttctcaaactcctggcctcaaatgatctgcccgccttggccaccgaaagtgctgggattacaggtgttgagccactgcacctggtcattatgttttaaaattacatacaagttgttaaaaaaatatgaacagcagaaatagattttagaaaaacagaatgaaattatccatctcttcccccatttagtgaatatttggagtatttcttttcacactgtaggtattataattcctgatttattagaagcagggagtggctgggcgtggtggctcatacctgtaatcccagcactttgggaggctgaggcgggcggatcacctgaggttgggagttcgagaccagcctgaccaacatggagaaaccccatctgtactaaaaatacaaaattagcctggtgtgatggtgaatccctgtaatcccagctactcaggaggctgaggcaggagaattgcttgaacctgggaggcggaggtttcagtgagctgagattgcgccattgcactccagcctgggtaacaagaatgaaactccatctcaaaaaaaaaaaaaaaaacagggagtgaggcccacagaaaccaaacaaattgttgatgatcaccaagcttgtaaatagggtaagattcaaacctgtgtatctgactccaaagttatactatttatactattccaaggagtattttaagtatttgttccatttagttagaaattatttactgtgatataaagtctaatgaatttcaactttagatttatgattgcttttgtaaaatatacagataatttgcaaagtaaggtttttttttatttttatttttcgagacagggtctcactgtgtcacccaggctggagtgcggtggcacgatcacagtttaccacagcctggacttcctgggctcaggcaatcctcccacctcagcctcctgagtagctaggactataggcacctgccgccactcccggctaacttttgtctttttggtagaggtggggtttcactatgttgcccaggctggtctcgaactcctgggctcaagcgatatgcccgcctctgcctcccacagtgctgggattccaagtgtgagccaccatgcctcacacaataaagtttaattatttgtagtaatttcccattcaaacgaagaccaaaattcagcttgaagggaacattcaatagcattccacaaagtcaaatgagttttctgccttagagttttccttagctggtttaaaattccaggtctgtttttcttgatccatagcatgcttttttctctcttaaaaatattttagaagaagattgttaggatttagaaaaacatagcatataaattcttgaaccattcatttttaaaaataatttaatttgaaaggtaaaaatatactttctactttctgtctcactaaatcagtctattctggacttttcctataaaagatgtatgtggccctttgtgaccgtcttctttcacttggcagagtattttaaaggtttatgcgtgtagcatgtatcaggtacttcatttcttgttatggctacatagtttttgttgtatgactgtaccacattttaaaaatctattcatcattgatggacacttggattatttccactttttgactattctgaatgatgctgcggtgaacttttgtgtgtgcatatgttttcagttctcttgggtgcgtttatacctaggaatggtacttccatatttaaatttttgaggtactgccaaacttttccacagtggctacaccattttaattcttaccagcagtgaatgaaggttccaatttctctacttcttcaccaacacttgttatgtgtgttttttattataatcatcctagtgggtatgaagtatttatttgcagttccttgatgactaataaaatttagcatctttcatgtgcttatggaccatttttatgtcttatttggagaaatgtctattcagatcctttgcccatttttaagtcaggttgtcttttattattgatttgtaagagtttttttttaatatgttctagatgtaagttccttaccagatttgaaaatgttttcatccattctttaggttatattttcccatttttcatagtgactttgaagcacaaaagtttttaattttgatgaagtccaatttataaatgttttctttcgatacttatgcttttggtatcatatgtaagaaatcattgtctaattggacttcatgaagatttactcctttgttttcttctaagagtttcataggtttagcttttacatttaggtttttatccattttgtgttactttttccgagaaaaggatccagtttcattcttttgcacgtggctatccagttcatttgctcaaaagactatttctttcccattgaattgtcttcacactctatgaaaaataaattgacctaaatgtgaaagtttatatctggacgccagttcagttcatccatatgtctatccttatatcagtatacattgtcttgattacgccagtttttttttttttttcgaaatggagtctcactctgttgcccaggctggagtgcaatagcgcgatcttggctcactgcaacctctgccttccaggttcaagcaattctcctgctccagcctcctgagtagctgggattacaggtgcgtgccactacgcccagctaatttttgtattttcagtagagatggggttttatcatgttagtcaggctgatctcgaactccttgacccaggtgatccgcccgcctcggcctcccaaagtgctgggattacaggcatgagccactgtgccaggccgattactctagctttgtagtaaattttgaaattgggaaatgtgagtcttccaaattttttttttccaagattggttattctatctccatatgaattaggatcatgtttccaatttctgcaaagaagtcagctggaattttgatagggattatgttgaatctgtagatcaatttgggaattagtgtcattttaacaatattacatcttctgattcattaacatgggatatctttctgtatatgtaggtcttttaaaacttctctcaggactgttttatcactgtcagaggataagttttgcacttcttaaaaccaagtaagctaagttagcaattcccaaaaattatatgagatggtaactcccgaaattctgtggcataacaagattatttccttaatggcaagcatattctggccccagaataatttagaatcaagtatagaattcaagagaatcaaggctgcagcagtaatactttgagtctatacccttgtgtatatttggcttaaatgttttaggagaattggcctttgaaaatttaagatatttgttatttcaaaataaaatgtgtaatcaactaatacaaagcaagttttgtactttttgttgaatttattactaagtattctttttgatgcaattgtaagtagaaatatttatttattaagagatagggtcttactgtgtggcccagtatggccttgaactcctgggcttaagacatcctcctgctgcagcctcctgagtaactgagattacaggtgtgcaccacctcgcctggctcagaatggttttcttaacttcatttttagattgttcactgtgaatatatcgaattacaatagtttaggctgggcatggtggctcacgcctgtaatcctagcacttggggaggctgaggtgggtggataacttgaggccaggagtttcagatcagcctggccatcacagagaaaccttgtctttaccaaaatcacaacaaattaattagctggttgtggtggtgcatgcttgcaatcccagctactggggaggctgaggtacgagaattacctgaacccaggaggtggaggttgcagtgaaccgagatagttccactgcactccagcctgggcgacagaacggtttttgtatgcttcaaccttactgaactcatttattcattctgatatttactttagtggattctgtatgattttctatatgcaagatgctgtcatttgcaaatagagatagtttttctttttttgtttccaatctgaatgtgttttatttcattttcttgcctaatgctcctcattagttttcaatgttgcatagtattttattgcatggacgcaccataattacttttaccaatctcttattgatggacatgaaggttatttccaaactcttgtggttataacaatgctgtaatagataacctattacaaagaacagttctcaactcttttggtcttgggactactttacctatttatgtataagtttcaagtttgggcttagaaagaatttaataatcatgctaattttgttttgttttctttttttttactcctggacccaagcggtcttcccacctcaacctcccaagtagctgagactacaagggtgaaccatcaccctgggtaatttttaaattgttggctgggcacagtggctcacgcctgtaatcctagcactttgggaggctgagacaggcagattacctgaggttgggagttcaagaccagcctggccaacatggtgaaaccctgtctctactaaaaacacaaaaaatgagccaggtgcagtggtgcgtgcctgtaatcccagctactcaggaggctgaggcaggagaattgcttgaattcaggaggtggatgttgcggtgagctgagatcgtgccactgaactccagcctgggcgacagagcaagatttcatttcaaaaaacaaaaagaaaaaaatttttaaaaattgttttgaagagatacggtttccctatgttgcctaggctggtctcatgcgattctcctgccttggcctcccaaagtgttgggattatagacatgagacaccacaaatttaaacaaggactttttttattttttaaagagattactttttctgagtaaacaaggacttttaaaacaaggtactaaaaatctggctgggcgtggtggctcgctcctgtaatcccagcactttgggaggctgaggtgggcggatcacgaggtcaagagatcaagaccattctggccaacatagtgaaaccccgtctctgctaaaaatacaaaaattagctaggtgtggtggtgcacgcctgtagtcccagctgctcaggaggctaaggcaggagaatcacttgaacccgggaggcagaggttgtagtgagccgagatctcaccactgcactccagcctggcaacagagtgagattccgtctcaaaaaaaaaattttttttaataaataaataaataaaaatcttgaaatttttattaggtcctggtgtttctaattttaatatgatttagttctcaagtgctagttaatacttcattaatcagccagatggaagtggggatactatggaaacagcataggcaaagcttaaagataaatgagaccatggtttgaaaatatagggtggcatgcgctttggttcaaggcaatttgatcatcacaacaatttggcttaaacagcactttggttgaaaatgaatatcccctagttatgtgtttttcaagtattggtcattttggtatatcatgagttgttttgcaaacttttgtgccaaagttttcaggaaaactttctaatatttgcttttgtgtttctaactgattttcagagaagttgtaattttgatgttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaaacatgaacaatataggatcttatccttttaagctatcatgcaagaaacatgtgaggtctcttaaaaattcactgtgctggccgggcatggtggctcacgcttgtaatcctagcactttgggaggctgaggtgggtggatcacttgaggtcaggagttcaagaccagcctggccaacatggtgaaaccccgtctctacaaaaatacaaaaatcagccgggcatgatggcgggcaggtgcttgtaatcccagctacttgggaggctgagacaggagactcgcttgaacccgggaggcggaggttgtagtgagccgagattgtgccactgcactccagcctggatgacagagcaagactccatctcaaaaaagaaaaaaaaaaaaaaattgtgctggctgggctcagtggctcacacctgtaatcccagcactttgggaggccgaggcgggtggatcacctgaggtcaggagttcaagaccagcctggccaacatggtgaaaccccatctctacaaaaatacaaaaattagccaggcataatggcgagtgcctgtaatccaagctacttgggaggctgaggcaggagaatcgcttgaacccgggagtgagccgagatggcgccactgcactctagcttgggtgacaacagcaagattctgtctcagaaaaaaaaaaaaaattaactgtgcttataaatgggagctaaattaggaaaaaaataaaaagtaaaaagaaaatgaaaataaaaatttaaaaaatatattaacaaattaactgtactaaggtaggattctttttttttttcttgagacggagtcttgctctgtcgcccaggctggagaggagtggcacaatctcggctcgctgcaacctccacttcccgggttcaagtgattctcctgcttcagcctcccgagtagctgggattacaggtgcctgccaccacgcccgcctaatttttgtactttcagtagagatgaggtttcaccatgttggccaggctgctcttgaactcctgaccttgtgatccgcctgcctccgcctcccagtgttgggattataggtgtgagccaccacacccagccactaaggtaggattctgatctcacctgtatgttatttattatgcctctcttaatctttattttaaaatagaggtcaggttttttgttttctttatatataaagtatggcacattcagttgttcatcattcaagatgccttgccattcagctctgtttaatgatgtggaccaccctctagaaaagaaaatctttatcctatcttgagcattttggttttgaaagttttagatcaattgtaatttcggtatggtgttagaggataataagaagggaagtgtaaggtaaaaattggggcacatctataatgctgttaaaaacagacataactgaaaaatacaccagagaagcaaaaagtaccttctccttgaccattctagaggtgttgcagaagaaacagactttaggtgaagcatatatgtgagtataattatgttgcgcttgcttcttaatgaaagacatgtcaatgaaggactaggcacaaggtagagacgctgataatgttgagtcagctcaggaaattggacctgaagtaagaagatagagattccttaggatgccttgaccctcgagtagcaatatccaaataaaaatggcttaaaggaaagccataaaccaagataacattatctaacaagaagtctgaaggcagggcttttccattgacagtccaaggactcaatgataccatcagatacctactctgctcttctctctgttacacattcagccagtttgtgatatctttcctaagggttttaaaagggcttcagcagttccagaggtcacatgtagccataactaagttctatggagaaacagcagtttcctcctgtgcatatcccggtattagtgaagaaaccttttccaaaggcctgccagctaccttcaactctcttagaccccagtagctaggattgggttggttacatgccacgccctggctgtaagggaggctacaaggaagacttactggcactttttggcctctgaagtacaggcagactgtgccagccaggaagaaaggtagaaaaggaataattggttttgtttgtttgtttgttttgagacggagtcttgctcttgttgcccaggctggagtgcagtggtgggatctcggctcactggaacctccgcctcctgggttcaagtgattctcctgcctcagcctccccagtagctgggattacaggcacctgctaccatggctgactaattttttgtatttttagtagagacggggtttcaccatgttggccaggctggtcttgaactcctgatctcaggtgatccacccgcctcagcctcccaaagtgttgggattataggcatgagccactgttcccggccagaaggaataattgttagacaactcacagtgtctgccatatttgccacagaaaataactgacttgctctctgctgtcttactgtgataatatatttttttaacgcaatttacaaaagggggggaacattcttaaatttgaaactaggaattatgatatttgcagtttcatattgtatacagtaaacagtcttcaaattctagttctccttgagatcttatacaatgataacagttttaaaattatgccttctgttttttgaacagctttttactattgacagcttttaaggaagtagttttcatgttgtcgtgtttactctcttactagacaggaagacagaacagaaatccatcctcaacttctggggataatctgaggattataatgaaatatcagatgcttaaatgatttcaacagacttttagatgaagttgccattagcaccttgttatcatcaatgtaacacataggcaagtggattaaaataagagggctaaactggcctttatgttgaaattagaagtttcgttgtcctacaggcagaaatgacagtttcattggattctctatgttatagtaatatatcagaaggatagcttgagatgagactattttgaagatacatggggtggatattcaaagtgccttttacatagttactgtcctccacagtttccccattaaatgtggaatccttgtgattgcattcttggagggccatcgaaaactagtgaagcacagagagactattttttttctatagatattaatctaaagcaataattggcaaaaaaaaaaaaaagagatttaaaatgtaggataaaggccaggtgcagtggctcatgcctgtattcccagcactttgggaggctgaggcaggtggatcaccagaggtcagaagttcaggactagtctggccaacatggtgaaactccatctctgctaaaactacaaaaacttagctgggcgtggtagtgcgcccttgtaatcccagctactggggaggctgaggcaggagaattgcttgaacctgggaggcagaggttgcagtgagccgaggtcttgccactgcactccagcctgggcaacaagagggaaactccttctcaaaaaaaagaaaagaaaaaagaaaataatatggtgctgtgctatgggataatggggaatacctactttatatagggtgttcagagaaggccttgaaaagaagaaacatttaaactgaaattaaaggctgagttgaagcaacctattaaagagctgtgggaaaggcatcctaagtgaaggaaatggcgtgtggaaaaactgtgatacagaaaagaccttgacatgttttaggaatggacagaaatccagtgtgactgtggttgtcctagtggagaatgttgtgattttggacaggtggataagcagtcagatcatataggcaagtgctttacatttttaccttttgtgcagtggaaaacccaattggaagtatagtaggcataaattttgtagactacatacttaaatatacaaagatgtaattttctttctttctttcttttttttttatttttagagatgactttttgtttgtttgttttttgttttttgaggcagtctcactctgtcaccaggctggagtgcagtggtgcaatctcagctcatggcaacctctgcttcctggtttcaagcagttctcgtgcctcagcctcccaagtagctggaattgcaggtacacatcatcacacctggctaatttttgttttttgcttttttgagacggagtttcgctcttgttatccaggagtgcaatggcgtgatcttggctcactgcaaccttcacctcccaggttcaagtgattctcctccctcagcctcccaagtagctgggattacaggcatgcgtcaccacaccaggccaattttgtgtttttagtagaggcgaggtttctccatgttggtcaggctggtctcgaactccggacctcaggtgatccgccctccttggcctcccaaagtgctaggattacaggcgtgagccactgcgttcagcctaatttttgtattttttagtggagacgggattttgctgtgttggccaggctggtcttgaacccctaacctcaagtgatccaccgccccttggcctaccaaagtgctgggattacaggcttgagccaccatgcccagcctagagatgaggtcttgctatgttgcccaggctgatctccaactcctgggctgaagtgactctcccaccccggccttttaaagtactgggattacaggtgtgagccattgtgcttggccaacttcatttctaaataactaaaatttccttagctctgtttctactaggtaatagagaacaatcctgctaaacaatcttgccactttaggataaaaagtcagtagcttctggcttaactaaattaattacatgttaatctaaacccttggtaaatacttggtccttttggtaaatgttcagtttcctcacagagcccaccccttccctttttttccctatggtagatggtattggtagagaaatcttataatttttcctggcattaagggagagtcatcttatctttgtgctgtcctctgtccttctgagccattgcaaatgactggcttggtcttgaatgggattgtctgcctctgccacttctgaggatgatgtccctgctactactgtagcccctgggcaacacatctgtgcatgctgggtcctccttaatcccaggctgttttgggtatactggcccagtggtgagtgctgatatgcttgggaccctaataaagcagcttttcaggaatatggtttgggcatgtcattggctattatgcctttagcaaggcatgatattgtattaggtgcaaggttttactaaatggctacagtccctggaccataacttgggaaagggaaacacaattatttcccattctgggtccttccccacaaacactggagatttttcttacccttccgcaaataagattttttttttttttttgagacagtttcattcttgttgctcaggctggagtgcaatggctcgatctcggctcactgcagcctctgcctcctagattcaagcgattctcctgcctcagcctcccgagtagctgggattataggcgcttctaccacacccagctaattttttgtgtttttggtagagacagtgtttcgccatgttggccaggctggtctcgaactcctggcctcaggtcatccaccctccccggcctcccagagtgctgggattacaggcgtgagccacctcacctggcccctcaaataagatttagctccagataggacaggaggcaaaaattctaaatttacatccactctttcttttaactcttgtttttctttgaactcttcccccaagtttttatgtcatcttgatcagtgtgagagaactgtacttatgtcatcacctgcctttcctctgtgctggagtctacatgacaaattctgccatgaaagttttcttgatttggttggtgatagttaaaatcacagttttagaatttaaaaagctgtcttggccgggtgcagtggtatggttctgaggattaattttatatacacacatataaacactcacacacacatttgagttcaaaatgtatgttactacattttacaaaggaataagtgatttcatagattctgtatcaatattaaatcttggctgggtgcagagcctcatgcctgtaatcccagcactttgggaggctgacacagttaagatcacttgagcccagaagtttgagaccagcctaggcaacatagtgagaccctgtctctacaaaaaatacaaaaattagctgagcatgttggcacacacctgtagtcccagctactcaggagactgaggtgggaggatcgcatgagcccaggaggttgaggctgcagtgagctatgattctaccactgcactccagcctgggcaacaagagagagaccctgtctctcaaaataagtaaataaataaataaaaagttctcttttggccaggcacaatggctcatgcctgtaatcccagcactttgggaggccgaggcgggcggatcacaaggtcaagagttcgagatcagcctagccaacagggaaaccccatctctactcaaaatacaaaaaattagccggaagtggtggcgggtgtctgtaataccagctactcaggaggctgaggcaggagaatcacttgaacccgggaggcagaggttgcagtgagctgagattgcaccattgcactccagcctgggtgatgatgtgagactccatctcaaaaaaaaaaaaaaaaagctctcttttctcttaagcctgtaggtcttatgattgaaattcttagctttcaagaattatcattttaatggatcaaagacctaaatataagaactgaaactataaaacgcttagaaggaaatgtaggtttaaatattcatgaacttggatcaggcaggtttcttaaatatgactccaaaagtgcaaaagaacaaatagataaattggactttattaaaattaattttttttttttggtgagatggagttttgctctgttgcccaggctggagtcagtggtgccatcttggttcactgcaacctctgcctcccgggttcaagcgattctcctgcctcagtctcccaagtagctgggactacaggcgcgcaccaccacgcctggctaatttttgtattattagaagagatggggtttcaccatattggccaggctggtctcgaactcctgacctcgtgatctgcccactgtggcctcccaacgtgctgggattacaggcatcagccactgcgcctggcccttaaaattaaaaatttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaatcccaacactttgggaggccgaagtagacggatcacttgaggtcaggagttcgagaccagtctggccaacatggtgaaaccccctctctactacaaatacaaaaattagctgggcatggtggcacgcgcctgtaatctcaactacttgagaggctgaggcacgagaatctcttgagtccgggaggtggaggttgcagtgagctgagaccatgccactgcaccccagcctggttgacagggcaagagtctgtctcaaaaaaaaaaaaaaaaaaaaagaagtggggtttcaccatgttgcctagactggtcttgaattcctgggctcaagcaacctgcctgctttggcctcccaaagtgctgggattacaggtgtgagccactgcacctggccaaaattaaaaacttctatgtttcaaaggacatcattaagaaagtgaaaagacaacctacagaacgggattaaatatttgcaaattgtgtatctgttaagggtctagtatttagaatatgtaaagaactatcacagctccataagaaaaaagcaaataatccaattgaaacaatgggcaggccaggtgcggtagctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttgaacccaggaggctgcagttgcagtgaatggagattgcaccactgcactccagcctgggcgacagagcgagactccgtctcaaaaaaaaaaaaaagggcaaagaatttgaagagatatgtctccaaagaaaatgtgcaaatggccaaataaacacatgaaataaacacatgaaaaggtgttgaaatcattattcattagggaaatgcaaataaaaatcacagtgaggccaggtgtagtggctcattgcctataatcccagcactttgagagactaagtcaggaagatcacttgagcccagaagttagagaccagcctgggcaacatagggagataggcgtggtggtttgtgcctgtagttccagctagtcgagaagctgaggtgggaggatctgcttgagcctgtgccgtcgaggctgcagtgagcagtgatggtgccactgcactccagcctgggcggcagagcaagaccctgtctctaaaataataaatgataataataataataatagagataccaattcacacccactagaatgactataataacttaaatctcaaaaaaaaaaaaaacccaaaaaacaaaaccccaacaactgttggtgaggatgtggagaaatgggaacccttatagggttccttactgatagggatgtaaaatgatacagatactatgggaaacagtctggcagttcctcaaaaagttaaacatacagttgccatatgacacagcagttccattcctaggtcatcccaagagaaatgactacatatgtccatacaaatacttgtacatgagtgttaatagcagcaatattcataattgtaaaagagtgggaacaacctaaatgtagatcagctgatgaatggataaacaatatgtggtccagccgggtgtggtggctcacacctgaaatcccagcactttgggaggccgaggcaggtggatcacctgaggttggaagtagaagaccacctgaccaacatggagaaaccccatctctactaaaaatacaaaattagccgaacatggtggctcatgcctgtaattccagctacttgggaggctgaggcaggagaatcgcttgaacctgggaggtagaggttgcagtgagccgagatcatgccattgcactccaacctggtcaataagagcgaaactttgtctcaaaaaacaaaacaaaacaaaaacaaaaaccagtatgtggtccatccatacaattcagccacaagaaggagtgaagtacagattcatgctgcaacatggataaaccttaaaaacattatgctgagtgaaagaagccacgaaagatcacatattgtatgatcccacttatatgaaatgtttagaacaggaaatccatagagatagaaaagagataaatggtttctaggagatggggagggaggcaattgggaatgactgttaataggtatggggttctttttaggtgatagaaatgttctggaattagtgtagatggttgcaaaatgtgaatacactaaaactactgaattgtatactttgaaatggtaaattgtatgctatgtcaattaaaaaaaagtataggccaagtgcagtggctgaagcctgtaatcccaggctttgggaggccgaggcgagtggatcacttgaggccaggagttcgagaacagcctggccaacatggtgaaaacccatctctattaaaaaaacaaaaactggctgggcgtgttggtacatgcctgtcatcccagctactggggaggctgaggcacaagaattatttgaatccaggaggtggaggttgcagtgagccaagatcacaccactgccctccagcatggtcaacagaacgagactgtcttgaaaaaaaaaaagataaattatggtatttgctttggaattaaataattagtaacttttagtaaggtttggtaaaggtttagtaacctttagttaacccagttaacttctgtgtcttatatttgtctttgtactgaagtagttgaatgccactgacccacagaatgagttgccagagaactggagcaacattctgtttgtgggaaagagaatactctgttactaccttaatattagattcccagcatatcaattgaagggttttaaatagtgagtgatgtgtttcaatttatatttatattatatttacacttgatcttagccaaaaggctgagaaagcgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccaacatggtgaaaccccttatctactaaaaatacaaagattagccaggcatggtcgtgggtgcctgtaatcccagctactcaggagattgaggcaggagaatcacttgaactcgggaggtggaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggtgaggaaaagtaagtagtcatgtgtggctctttgtttctggctttaataactccagtagttctggaagagacttagtgggaaacattttggataaactgagtttgtccaaatggggttgccaagtggagagttgagtaaatgaagctagagctcaggaaagatgtggaccagagttataagtcatatttatttatttatttattttgagacagagtcgtgctctgtcgcccaggctggagtgcagtggtgcgatcttggctcactgcaacctccgcctccggggtcaagtgattctcctacctcagcctccagagtagctggtattacaggcacgggccaccatgcccagctaatttttgtatttttagtagagacgggggtttcaccatgctggccaggctggtctcgaactcccgaccttaggtgatcctcctgcctcggcctcccaaagtgtttggattacaggtgtgagctactgagcccagcataagtcatatttaaaacaatgggaatgggtaggaacacctagagatagagtgtgggaaatagaatagggtccagtatacagctgtgccaaatttcacatgtacaggttagatagtggagtgggtcagttctgttgggaatgccctgaaagtttgaataatgataagcacgtccttttaacatcatgaggtagtggtgacgttgtaagaggagtttcagtgtagtgggttgtcatgggttaaaacgttcagattgtcatgggttaaaacgtgaattggatatgaggaagtggagtgcacaaagatagttttctgaaagttttacttggaagaggacaaaaaattgagacgacagtttgaggaggatgaaaggtcaagaattctaagctagtgataaaaatttcgtcaacatcaatgaataggtaatgtaaacacattaatcctgggatggatgtgagaagagcaaagaaaggaatcctgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagataaaaattttaagagccatctgcaatgtcaaatgtagcccacagttgaatgaatatgaggacagggaagtgtcccttgattttggtgttaagcagctgattgccaccttctgtagaacagcttcagtggagtctccataatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaggtgagaattcgggatatgaacactttatttttttcagtgaaggggggataaggtcatccactgagatagtggggaggaaatgatgattgtaggggactgaggagaaaaggagaatttcaagaaagcctctgagggaggtgagagggcaagctgagtgggaatacttagaaaaaatggaatcatggatttttcacggctgtggtatatatatttgtatgaatgatctcctccttctctcagggctcagcagcctgggtgaacacacaattgaacagttggattgatcttggcctggattttatgtgtcagtgtgacagagagggtaaggaggcaagatatttcagtagcgagagtgtttgaagtggtgggccattgagtctaggctgaatagggaacaaatgaaaccagaaggtggctgctgggacatgaagtggttggtgttcaagactggatagtggaattgaagattgaacgggaggagcagttgctggttatgacagagtacaggatccagctatggagtgggtttatgaagtagagacaacgttcccaagtctttagtgaacatcagagagtgtcatctgttagaactttagctgcggccgggcaaggtggctcatgcctgtaatcccagcactttgggaggccgaggtgggcggatcacctgaggtcgggagtttgagaccagcctgaccaacattgagaaaccccatccctattaaaaatacaaaattagctgggcgtggtggtgcatgcctgtaatcccagctactcgggaggctgaggcaggagaatagcttgaacctgggaggtggaagtttcggtgagccgagattgcaccattgcactccagcctgggcaacgagtgaaactcagtcttaaacaaaaaagaacttttgctcaaaggcaggtggtagcagataagagataaggaaaatttagtgaagaaaaattcagtttttaaaaacgttttaggctgggcgtggtggctcacgcctataatcccagcactttgggaggccgaggtgggcagctggcttgagcccaggagtttgaaaccagcctgggcaacatggcaaaaccttgtttctacaaaaaatacaaaaaattagtcaggtatggtggcatgcacctgtagtcccagctacttgagaggctgaggtgggaggatctcttgagcccaggaagttgaggctgcagtgagctgtgattgtgccactgcgctccaacctgggcaacagagggaaaccctgtctcaaaaaaccccaaaaaacaaaaaacagcattttattttggtgatggaattctctattgtttcgaagagttttgtttgttttaaagacattaaccagttttctcgagggatattctatgaaaaagtgggttccatcatccaataagtttgagaaactgcaaactctatcccattggtaattcacaatgaacctcaacttagattaataaaggctctgggaaatgatgttactattaatgatttaacctttattgagcactgtctaaggctctgttctaaggctcccacgtgcattattgtttccagtctttacagcaactatctcatttaagttacactgctaagctagaatggaagagctgggattcaaatccagaaagacttgctccatagggttctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactgcagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcttttctctggtctaagattatctcattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctccacctctttactatagctgtggccttagaaaacctacttcatttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaactagctttggtgctgacttctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcgagaccatcctggctaacatggagaaaccccgtctctactaaaaatataaaaattagctagccatggtggcgcgcacctgtagtcccaactactcgggtagtcccaactactcggaaggctgaggcaggagaatcacttgaacccgggaggcggaggttgcagtgagccaagatcgcgccactgcactccagcctgggcaacagtgcaagactctgtctcaaaaaaaaaaaaaaaaatcatgtatataggacagaattgcttatattttcacaattactactggatgcctgtttggttttcatagcaatcaacttttggagtttatgggcagtacttaacatatataacctaagtgtggataattatttaaaataaggctactggaagaaaaatctatagggatttctcagttttcacaacagcatcctgagcaaagaaaaaataggttggtttgagttgtatgtgatgagatttctaatattctattcgaaatgccccctagtaagcactagtgataggtattaatgagctgaatttgatttctagttccaactctgtcccttgcaacttcggtaaccttgaaggtttgtctacgtttcagtttcttcatatgtaaaagagattaccaatatttccctcccaaggctgctgtaacagtgaagtgttgaggtatttatttatttatttatttatttatttatttttttgagacagagtcttgctctatcgcccaggctggagtgcagtggcatgatctcggctcactgcaagctccgcctcccaggttcatgccattctcctgcctcagcctcccgagtagctgggaatacaggtgcccgccaccacgcccggctgattttttctatttttagtagagacagggtttcaccgtgttagctaggatggtctcgatctcctgacctcgtgatctgcccgcctcggcctcccaaagtgctgggattacaggcgtgaaccaccgcgcccggccgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctgtattgaagagagaatattaatgtttgcgaagtaaactgaaaatatttcctttgcagcccacacttgagtgttttaggccgggtgcggtggctcacgcctgtaatcccagcactttgggaggccgaggtgggcggatcacctgaggtcaggagttcgagaccagcctcaatatggagaaaccctgtctctactaaaaatacaaaattagctgggtgtggtggtgcatacctgtaatcccagctacttgggaggctgaggcaggagaattgcttgaacccgggaggcagaggttgcggtgagccgacattgcgccattgcactccagcctgggcaacaagagcgaaactctgtctcaaaaaaaaaagagtgttttagcaaaaaatgattttatgtatgacataccttggtttaaatcctggctttttaattttaattttttattttttgagacagggtcttactctgtggcccaggctggggtgcagtgatgtgatctctgctcactgcaacctccgcctcccaggctcaggtgattctcccacctgagccacctgagtagctgggagtagaggtgtgctccactatgcctagctaatttttctatttttagtagagacagagtttcaccatgttgcccaggctggtctcaaactcctgggcttaagtgatccaccagcctcggcctcacagtgttgggattacaggtgagagccaccaagcccggcctgaatcctggcttttgaatgtaatagtgttgtgaccttaggcaagctgcttaacctatccataaatattatgaggctaaagtgagtaatagtatgtgtaaaacatctagttcattgtctggtttgtatatttccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggctttgcctgtaatcaggttcagcaaaagtggtattttctttctttcttttttttttttttttttaattgagatagtctcgtcctgatggccagactggagtacagtggtgtgatctcggctcactgcatcctccgcctcctaggttcaagcgattcttccacctcagcctcccaagtagctgggatcacaggtatatgtcaccatgcctggctaatttttgtattttttgtagagatggggtttcgccatgttggccaggctggtcttgaactcctgacctacagtgatccgcctgccttggtctcccaaagttctgggattacaggcgtgagccactgaacctggccaaaagtggtattttctattgcatttgaggtaacagaaattgatgggcttgttattgcatttggcgtggctggttttttttttccatgttgtctttctccactgactgtcaaaaaaaaaaaaaaaaaaaaaggctacattcatgagtgccacaagagagattcatgattcccaagtgctacagcagaccaaggtatctaaaaagtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcgttggaaagctggtgctaagagtgttatgagaattcctaataaatagaaaagctcaaggattgacactatagtaaaagatttcattttgacatgtttataatttacttatcaagttaacaataaggtgtttttatttatttatttttgtttatttttattttattttttgagacggagtctcgctctgtcgcccaggctggagtgcagtggcttgatcttggctcactgcaagctgtgcctcccgggttcacgccattctcctgcctcagcctcccgagtagctgggactacaggcacctgccaccacgctcggctaattttttatatttttagtaaagatggggtttcaccatgttggccaggatggtctcaaactcctgaacttgtgatccacccgccttggcctcccaaagtgctgggattacaggcatgagccactgcacctggcctttttttggtatttttagtagagacggagtttcaccatgttggctaggctggtctcgaactcctgacctcaaggcctgccttggcctcccaaaatgctgagattacaggcatgagtcccaataagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgattgagttctatatttacacagcatgaaagtctcagttgcattaagtacattcgcattgttatgcaaccatcaccattatctagttccagagttttgctgtcaccctaatagagcttgtatatatgtctccaccaaatcttatgttgaattgtaattcccagtgtttgaggtggggtctgttgagaggtgtttgggtcatgaggcagatccctcatggcatagtgttgtcctcgcagtagtgagtgagttctcacgatctccttactccatccacctgcttctcctaaaactttgaaatatgcttggaattgaaagtgtttagtttgaggatagttatctaaaagtgacatacagggctcctgctttgctcttccttagtaaatttcctattttattacacagtttactaatacagaggactagagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggatgtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggctgcagtgagctgtgatcgcaccactgcactccagcctgggtaacagaatgagaccctatctcaaaaaaaagaaaaaagtctatgtggaagataccacgttaattgttttgggtggtttagagatgtttctgtctccttcactgatgaccatgtgtctctgctgctgtcgctcactggtgattatcaactcaacttcttacatttgttttaacaaatatttatacaccctttgtaaatttgcatgagataaagtcattatagttaaaaaaattgtttttttttttttttttgagacagaatcttgctccattgactaggctgagtgcaatgacatcatcatggctcacggcagcctgaacctcctgggctcaattgatcctcctacctcagcctcctgagtagctgaaactacaggtgcatgccactatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaattaaattaattggtttcattggcagtattgaatttcaaagcagaaggggtgcttaagagaaataatgcctttggagtaatttctgatgctagatgaaactcatatctcatttaaggtgtccatctgaattttatgtttggatgattatgaattattccttaaagcttgaagtgaactctggctctctaggacaaattaatctttattcctttaatctttattcccttaggtatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgtggtggctgacgcctgtaatcctagcactctgggaggccaaggcggcagatcacctgaggtcaggagttggagaccagcctggccaacagggtgaaaccccgtctctactgaaaatacaaaaaaatgagccgggcgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaacaataaaaataaaaatacaaaaattagctgggcgtggtggcgggtgcctgtaatcccaactactcgggaggctgaggcaggagaatcgcttgaacccgggaggcggaggttgcaatgagccgagatcacgccactgcactccagcctgggctacaagagtgagactctgtctcaaaataataataataataattctcagtaatttttgcaatttttttggtacctaaaataatttctgttattgtgttggataactttgtcaacttcactttgggaatatctaaatataggtagctgcattcgagccagaggaatattgggtttttttgttgttgcttatttttgaggcagccttactttgtcacccagactggagtacattggcacaatcatggctcactgcagccttgaccttctgggctcgtgtggtcctcccaacccagcctcccaagtagttgggactaaaggtgtgcaccaccatgcctggctaatttttaaatttttttgtagggatggaattttgctatgtcacctaggctggtttcgaactcctaggctcaagcagtcctcccaccttggcctcccaaagtgctgggattacaggtatgagccaccacacccagttgagcaatactgggttttaatcaagattattgtctgaatattgagtcttaatgacttttttgattttgtttttttggccatagtattaagtttgcagttgataaccttctgtactaactagaagtagtatagaaactgcaaattaaaaaaaaaccccaggtaaaatgttgatggctgctatttttatttaaggtattagtaaaggaaaagaagtcagggacattatggaggtcaagttttatattattaaaactcaacttcatgatttatacatacttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcataatgtatttctccattgaaacagtatggtttgaacagtgctatatattcttactcattattattccttaaatgaatattttaagctcctgatagaaggcaggtactgtgttatatgctgttggtgttaccagaatacaaagatgaagagaacaaagtattacacaattcctaatctcacataaatgctattttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactaagttaatgtatagctggtagaaagttttcacttttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgcccccccccaccccgtctgccaccccccgcctcccacttttttgttgggaggcttatgtgagagcattagaggccttgaatgtttgggtagacaaggtaagtattcaaataaacatttcaagatcattgtgacagtgaaattatttgatatgaaaaaggatctcagttattagaaaaaacacaactgtgttaatactgacagccagcgttgctataagtgttttatgtgcattatctcacttaagctttacaacagtcctaagagaggaatgctgtggttattacacccacttgacagaccagggagcagaagcacagaaacccaaggatttctgccgtcagtgtcatgcatttggctggagttatgatgtcgtgcaagtaatgttccttctttttccctctaattcatttttatgtttttcttttacagggcaattttgtaagatttagtttccaggggtcaggtttgtttgggttttatgtccttgggaaatcctcagtaccttatttcccatattccatattttttaaccttaattttttttcccctcaaatgttatacagtttaatgagtcaagtggtctttcagggattgttaaaacaaacagtaattctcagcttccaccttcatttcctcctctcataggtaaccatcctcaactcataggtatttggaatttacctgtggtttttcaagaaacatttaaaaaattgatttacttgaattttcaggttagaacataaattatttgcatgatttgctgtgtccttgtgactaactcaaactaaacattctatcagttgtccaaatttcccattttctttcaaatttcccatttccttcacttactttgtcagtttcatcatcttgaagaagccttttccagagcacagtgctccaacatggagtagtctctgttttctcatagtgcccagcaattatccttggaattctcttttcttttctcctgcattggcacttctgtttcttctcctcttatgtcttcctgtttcatgggaggcaaatatttgataccttatgttttttgaaaacactttattttcctctcacccttcattagtggtttcactgtatgtaacattgagattgatgattttgctccattgtcttctagcttgtgttatgcctgttgaaagtacaaaatcattctggaagcttatctattgttagctatttccctcttctggaagcttgtaggatcttccctttgtttccactgttctgaaacttgtaaatgatatgctttaatatggttgtactgtattttaaacaattatgctctgcactcagtgtttttttgttgttgtttttgttttttaatttttaaatttatttatgtatttttaaatttattgtttttgtttgttttttgagacggaatcccactctcgcccaggctggagtgcagtggcatgatcttggcgcactgcaacaacctccgcctcctgggttcaggtgattctggtgcctcagcctacccagtagctggaattacaggcgtgcatcaccacgccaagccaatttttgtttttttgttttgttttgttttgtttttttgagacagagtatcactctgttgcccaggctggagtgcagtggtgcgatctcggttcactgcaacctccgcctactgggttcaagccattctcatgcctcagcttcccgagtagctgagattacaggtgtaccaccacgactggctaatttttttgtatttttagtagggacggggtttcaccatgttgggcaggctggtcttgaactcctgacctcaagtgatccactcacttcggcctcccaaagtgctgggattatgggcgttagccaccgtgcctggcttcactcagtgttttcagttaggaaacttacattgtttagttttgggacattttcttgaattatttcactgattttttttcctctctgttttctcccgtggattccccattgcatagatgctgaattatcttgactggacctccagttttttcttctttattctgttgccatctctttgattccttattctttctgataaattttcctaagtttaatttccaagggctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtattctttccatggacactaatgatggggtataaaattccttttatttatttatttttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttgactatttgcagttatgcctctaaaagctgattggaagctcttagtacctcattggtacttgttgagtagagttcactctggggtgatctatctgtgtcatttgctggggcacccttcatgtcagcttctgattacttttcccttttctgaaaagggagaggtcttttaatttcctgtctggtgggaggaggtctgtatgccacttctgtgggagagtgagggaagtagggcagtgaggatttcagtattcagtacatatgtgttttcttaaggcttctgttttcattaagcctcccccgcaccaatgtgctttatgtttccctgctctgaaatcctcctgagggaataatcctctagaattttgccttggtgggaaaagcgtagtaacctaaccatgtggtatttaggaaggtactgagagattgagcgtttcctaaggagctttcagccagccttctttatttagtgctcccttcacacctgtttctacaggcgctatctgttaccagttcctgagccttttgaggattctgtggacgaaggttggtttttggctttccatactgctggtttcttggatctgctatgtcagttaccatttatgcatttgctttctagcttttaaattttgtttatgccttaaaaatacctgatgagggccaggcgtggtggctcaggcctgtaatcccagaattttgggaggtcgaggcaggtagactccttgcgtctgggagtttgagagaagcctgggcaacatagcaaaaccccatctctactatagaaaaattaacccagtgtggtggtgcacgcctgtggtcccagctacttgggagtttgaggtgggaggatcgcgtgagcctgggatgtggaggttgcagcgtgctgagatcatgtcactgtactccatcctgggtgacagaatgagaccccatctcaaaaacaaaaacaaaaaccccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatactcattaagcagtcactccccattccctccctccctcagcccctggaagccacgaatgtgctttttgtttctatggatttgccttttgtggatatttcatataaatgaagtcattcagtatgcggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttgggtatatacctcggtgtggaattgcgggatcatatatggtaattctgtctttaacttaatgaggaactgccaatctgttttcctcagtgactgtaccattttatattcctattagcaatacacaagtgtcccaatttctccacatttttgccgacactgttttccattaaaaaatttttattgtagtcattctagtgggtgtaaagtggtatctttttgttttgatttgcatttccccagtaactaatgacattgagccttttttcatgtgcttgttggccatttgtatatcttctttggaggaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgtcagaattggtgtcatttgtgtttatttaccaggttatttggaaggattatattttaggtgctctcctctcccccagtaaatggtattatgacacaagggttataaaggactgataagaaattacttaagacagaaagggaagttggcctgcttccaaaatatggtcccagcagaagtgaagttagttacacaaataactacagtcaaaaagctatttttatccatgataatgtatttgttgttattaatattaaagattatattttgccaggtgcagtggctcacatctataatcccagcactttgggaggcttaggtggatggatcacttgagctcaggagtttgagaccagccagggcaacatggtgaaaccccatctctacaaaaaatgaaaaattaaccaggcttggtggtgcgtgcctgtactcctagctacttgcgagtctgaggtgggaggatagcttgagcccaggaggtcaaggctgtggtgagccgagatcgtagcactgcactccagcctgggcaacaggacaagaccctgtctcaaaaacaaaacgaaacaaaacaaaacaaaacgactatatttctgcattaagtgggggtatagaatcctatctaatatttgagataataattgttatagtattttattgagcttttattgggtaccagatgtgttctaagtttttttcatgaattattttcgttaatcttattcattgttgtgtcctgaatgagtactcacatatttgttgaagggctcaatggtccctaaaaccttacatgctgttttggaaggttaacttgccaaaggtcacatagttggcaaatgatgaagctgagattaacattaagatctgattccaaagtagtctttcttaactatattgctttatgtggagttttgtcgctgatatctagacagaaagtctctagcaatggaaaaaaaataatttttaattaattttaatttttttagtgttttgcttcttttattttttttattttgtgagccaccgtgcccaattggtttcttttaaaagactagttagcttgtgctttaggcctcttgattactctgaggtatttaattaatatctttgaaatcctacgatttactgtatcacttctgcaatatctaaatttttccttcttacttatttctgttctccttctacagtcctttctattatgtttaatcatcaaaacattgttcttgttttctactgcagtctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatctcaggaagcacgaagtgtacacagaacgatatagctggaaaaagtatatatgttaaagaataatatgttgtctaaggacagaatggaactgatcacacaggttcttttttggtaagcttcaaaacttcttatctcccataaaagtactttttcttttataatatgcaacaataactttctgtttagttaattagttttaaagcaagcttaaacttataatttataaagaatcatatttgctccctatcattgttttatagctggggctatactgacaaataagaaaaataaaattcctgcccttgtggaggagacagttaaacaatgagacaaatacatttcagatggaaatgaggacaatggaagaagagtagagcaggatgaaggcatgaagggtgactgagagctggtcaatctttagatagtgtaatacaggaaactgctttgaaaagatgacttttgagcagagatcttaatgtactgagggagtgaaccatttgaggtctggggaaagaattcagcttcctcttcagatgtacaaaattataagatattgccattcttgtaactgaaaacctataaaagcaggataagaagtacggtttctaaaaacccatctaagagctgaggatacaagggaacctaaatgaaccaaactccagaaagtaatcaaactttcgtagtagagaagaaacccgtggttgctctaggatggaacaaccaaaggaataggaatccaccatagatgaggggaaaggagaaaccagccacatttttttaaatcagatttttaatggccacgtatgggctggtttgacaggttaggatcctgagaagccctagcaactctagcaccaaagagcaagtatgcacccacactccagctcctacccacagatgttcactgaatgttcaggagtagtaagccaaaagcctgggccagtgacgaactggcatagataatacctgaggcatttggaacctctcccaggtatagggcaaccacccttagaaggcaggattgctgagagaaatccagcagaggcactccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctggcctccagaaggctggctggagaggaggagcagggctgcacgagggcacctgagcttcagaaagcaaggtgtgcgactggagagcaaggagaatctagcaaaccaaactctgaccgtcgtgcttaatgcagagatagagctcctacagtttttttttctttcttttttaaaatataaacttgaatttttgaaatagtttcagatttaaagaaaaattgccaagatagtatagagagttcccatagatgctgcctctagtttttcctatttttatttaatttattttttttttagtttttcctatttttaacaccttatattagtatggtatatttgttataattaatgaactaatactgatatattttcattaactaaagtccatactttatttacctaatgttttgggatcccatttagctgtcacatctccttagggtcctcttggttttggcattttcttagacttgagcttctcatctcttgtttttgataactttgacagttttgaggagtattgttcaggtattttgtagaatgtccttctattgatatctgtttggtatttttgtcattgttacagtgaggttttatatttttgggacgaagaacatgcaggttaagtacaattttctttcctttttttgagacagtgtctcactctgtcacccaggctggagtgcagtggtatgatgacagctcactgcagccttgaactcctgggctcaacgcgatccaccctccttagcttcctgagtagctgggactacagatgcatgccaccacacctggctaattttttttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcggtgttgctattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatgggagatttgtctcttcttcctcatttatttatccattcaattttttaaatattagtatggacttatggatattttataccttgggttaaaatcttattattgctttatttattttattggtcaagttgttccagctttggccactgggagctctttcagttggtatgactttttgatataccactgtcagtgtatgtgtgtgtatgtgtgtttgcactttctcactttctggcactacaagatgcgctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgcacatgttgctactggggtgttgttgcttgtaggccatctcagctgacagagccagaaaatgtatgtatttatactaccctgtatatatccacatatctataaatatttctatatgtatccatctgtatctaattaagctaaacatgagtttatattgatgtattcggttccagttgaatcactacatggatgattctaacttcctgcccttgcttatctaaaaactcctgctccaatagtgagaaatctgtctcctaccatcagccacccatttacttaatcattctactctagcatacatgtaaggtactcccacagttttaaaaattggtggcttggctatgaaacacaagcaggtctctgtaattttacctaggctcagatcccagacctgctcaagtgaaggacttgatctcagtccttaaatatttgaagccagtgattaactgtcaaattacagctgcatcatagcccacacccagctcagttacatattggattgactcagactcccttctagtgtcctaacagaaaaattgtcgtgtctttttctggaagtaaaatattacttaatttaataagtaatctatttttatataaaatgtctggtgtgtaataaaaagttacaagacacaagaaaagcaagaaaatgtgaccaaaggtcaagagaagaaatagtcagtagaagaagacccagagatgatccagatttatcagaattatcagacagggatttaaagataattatgaaaaaaatgctggatgattgaatgataaaggttaacaatatgcttgaaaagatggggatttctgtagagtcatggaaattatgccaaagaaccaagttgaaattccattaaatagaggtgaaaaatatactagcagagaccagagaaaacaaaaaaaggaaagaaaagaaaaggaaagggaagggaggggagggaagggagaaagaaaaatatactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaatgtggcagaagacatatttgaagagacaatgctcaggaacttctaaaattgatgaggtcatcaattcacaaatggaagaagttcagcaaatcccaagcaagttaaatacaaaacaaaaataagccaacaaatttaaaaatcccatatataggcatatcataatcaaactgctgaaaattgaagatggaagagatcttacaagcaacaggagagcaacaggagaataaaggcacattagttatgtgagaatggcaacatgggttatggctaatccatgttttcagaccagaaaaaaatggagtcttagctgagcatggtggcacatacttgaacccaggagttcgagtccagcctgggtaaagtagtgagaccccatctctatttaaaaaagaaaagaagtccaggcatggtggctcacacctgtaatctcagaactttgggaggtgggcagatcacaaggtcaagaggtcgagaccatcctggccaacatggtaaaaccgcgtctctactaaaaatacaaaaattagccgggtgtggcggtgcacacctgtagtcccagctactcgggaggctgaggcaggagaatcacttgaacccaggaggtggaggttgcagtgagctgagatcacacgccactgcactccagcctgtcgacagagcgagactcagtctcaaaaacaaagaaagaaaagaaaagaaaaaatagaatgttaaatacaatgggatgacatccataaagagctgaaagaaaaaaaaaaaaacaacctgttaacctagatttctatggccagcagaaatagccttcaaaaataatggcaaaataaagacttttgggacatatcaagaagggaaagaatttgtttccagcagacctggactcaaaaaacattaaaacatacacattaacaagatgtgggttttacagcatatatgtgattatacaaccatgaaagaacaaaaaggaggagatggaattatactgtcatatatttcttactctgtgaaaggagactgtagtaacttctggatgcatatgtaatctctagaacaagcactaaaaacacaaacagggataccataaagtcagtacatctgcctaagagggattaactgctacaagaatcattctcctacagtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaataaaaggaactacacagaaatctatagaagtaagagaatctttgattggacactcatctgcacatgcaaagtgtggaagtcagcagtgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaaagccagcacctaacaattaaaatgttcagcattaataatatattaatgaaagattactaggcatacaaataataagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatatggtgactcacgcctacacacttgagggtgggcagatcatcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacagagtgagactttgtctcaaaaaaaaccaaaagactcacaagtagtatctaaagatgaaaaataccagatataatatccaaaactgggggaaaaactggatgtgattaacagcagattagacactgtggaaaaaaagatcattaaatgtgaaggtatagcagtagaacctattcacattgaagcacaaagagaaaaaaaatactagaacaaagttaatagaacatcagtaacctgtgggacaatagcaagttgcctaatacatgtataattggagttccagaaaagtggggaaaggtagaaagcaattactttaggaaatagtgtctgggtggccgggtgggtggctcacacttgtaatcctagcactttgggggccgagaggggtgcagatcatttgagatcaggaatttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaagaaaaaaataagaaaatagtggctcatcatggtggctcatgcctgtaatcccagcactttgagaggctgagatgagaggattttttgagcacaggagttcaagaccagcttgggcaatttccttaaaaaagaaaaagaaacagtgactataaattttccaaatctgatgataaccataaactctcagatccaagaaactcagtgaactctaaatagaataaacaaatataatcatacctaggtatgtaataataaaattagtgccagtcatggtggctcatgcctgtaatcctaacactttgggatgctgaggcctggagtttgagaccagcctgggcaacatagtgatacccctatctttacaaagattaaaaaatagaaatataaaaagttagccaggcatggtggcacttgtctgtaatcccacttacttgggaggctgaggtgggaggattgtttgagctcaggaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaaaaaaaaatttaaaaaggggggcatggtggcatgggcctgtagtcctatctactcaggtggctaaggtgggaggattgcttgagcttgggaggttgaggctgcagtgaactgtgttcgtgccactgcactccagcatgggagacagagcaagatcctttctcaataataacacataaaccaatgttacaattagaagaaataaattctggtgttcggtgtttttttttttttttttctgagatggagtttcgctcttgttgcccattgctggagtgcaatggcatagtctcggctcactgcaacctccacctcctggattcaagatgattcttttccctcagcctcccaagtagctgggattacaggcgcgtgccaccacacccagctaattttcatatttttagtccaccacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacattgaattgtggcccagcacggtggctcatgctggtaattccagcactttgtgagtctgaggtgggtggatcacctgaggtcaggagttcaagactagcctggccaacatggcgaaaccccgtctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacagagcaagactccatctcaaaaaaaaaaaaaatatatcaaattgtaccccataagtacgtacaattacaatatgacagtttaaaaaataaatttcaaaaaattctcttgtacttaccagctgaataaaaaataaatttttaaaaggagagaagtcttaaaaaccagttatttaccccatcattaagttataatgaactttcttatgggaattctttgataaggaagctcctttacgctgaagttttattcttttcatacctctttagataaatcagtgctttgggagcatatgtcatatgactcaatggcagtgttctaacttggattctagctccacattgtgcaaaggcaaaaaaccagagagtcagtgtggtagttaagaacttatgttttgctgtttgatttcctacatgccagtactccctccactacctgcagtcttcctgacctggggcaagttccttttgtaaactctgttttctagggggatggtggtggaagaaggatggtgatttgagccaggcagtagcaggtggaggtggagaaaagtggtcaaaccctgaatgaacgttaaagataggaccaaaaggatttgatgagaaattggaagtagagcacggggaaaaagaaagacatcagtgatgatgccaaggttttttggcctggggaattgggatagtggagttgttatttgctgagtatgacttttcacaaaggaatgtcaaggcgtaagtagcaaagttctttctttttttttttaatttttcttgattgtgtttgttttgtttttcatcttttgtgggaggtgggtggagatgaaagcaagcacaggggttggcaggcatacccctggcacctacctgtgagttcatgattactagtcttaaattcagtcctttttatttttacttttttttttttttttttttttttagagacagtgtctcactctgtcatccaggctggagtgcagtggcacaatcacggcttactgtagccttgacctcccaggctcaggtgatcctttcacttcagcctcctgagtagctgggactacaggcacataccaccctacccagcaatttttttttttaattttttgtagcgacatagtcttaccatgttgcctaggctggtctcgaactactgagctgaagcaacctgtctgcctcagcctcccaaagtaaagtactgtaattacaagcttgagccactatgcgtggccaaattctggcctcttgatgttgcatggcgtggatggggaggtgaagtgtgatattttaggaatttgaggatttcttcttcgaccttaggcgtgacattggacaaatgacatctgggctgagacattttctattaattctgaatccaaaaaactcttatcccattgtctcatagcttcattacacagacctggcagccatgatcctctttttttcccccttagttgtcaaacatgggttctctgtcttacctcatttgagtcttacctcagtcttgagagtctcaaatgtatatcatagtttttagacaaaattcaaccttatttcagttagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatactgactaaacaggacaccagaagagcatgcctaaactaggactgttctgggcaaatcagaaggcatgttcaccttattctttttattctttctttttttttttttttttttgtgacggagtctcactctgtcgcccaggctggagtacagtgacgcgatcttggctcactgcaacctccacctcctgggttcaagcgattctcctgcctcagcctcctgagtagtgggactacaggcacatgccaccatgcctggctaattttttgtgtttttagtagagacgggggtttcgtcgtgttagccaggatggtcttgaactcctgacctcatgatctgcccacttcggcctcccaaagtgctgggattacaggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccgcactggcctaaggcatctcagttgttgatgagaatgtgattacagatgtctcacttgaataccaaagacaattgcaaaggaaattaaaagttatgcaaagagagttgagaagtcagttgtctgctcacaggttggctttagtggctattactttgagatactaaatgagcaatagctttaaacttcaactgcttttgtttctgaggaaaaaaatcatcttatatcctttcataagtcgcataaaatgtggacattttctattattttaaagagtaaatttaggtacaagcatttactaattttttttttttttttttttttttttttgagatggtgtctcgctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcaccatgttagccaggatggtctcgatctcctgacttcgtgatctgcccgcctcagcctcccaaagtgctgggattgattacaggcgtgagccactgctcccggcctgtaattctttttttttttttttttttttgagacggagccttgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggtctcgatctcctgacctcgtgatccgccctcctcagcctcccagcatttagtaattcttaaaagagttcggcatgaatatacacagtacgtgggttattagtactgtgttgttaacacaaatgaactatgatagcaaattgaatttggttcaatcaggtcaaagaataaaaggatgattttctttaaccaacaagggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgattttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggctttctgcagattgagaaattgtataattattaactgcggtaatggagatgtacttgcaagtttcatctggtatcttaatgagctttaaccctctgaatacacctaaaacatatcctagaattattgaaattaatcagttgtccataacttttctgtctgtataatttggctatcatacatattttgtttccccctgcccttgccagtttccatcctcctactcacatactcacaactcctataaattggagtatttagtagcagtagcctttggtataaacactttttaaaaatttactattttttgatttaatagggccactttctagtcaaattttttttgggggtggtgaggagggtagggtaacagttccacacttacaagggtatttgtttagacgaagcttgttcaacccacagcctgtggggctgcatgtggtccaggacggctttaaatgcaacccaacatgagtttgtaaactttcttaaaacattatgagttctttttgagattttttttcgagacagagtctcgctctgttgtccaggctggagtgcagtggcccgatcttggctcactgcaacctccacctcctgggttcaagcgattctcctgcctcagcctctggtgtagctgggattacaggtgtgtgccatcactccaagctaatttttgtatttttagtagagacggggttttaccatgttgggcaggctggtctcaaactcctgacctcaagtgatctgcccaccttggcctcccaaagtgctgggattataagcttgagccaccgcgcccagcctgcgatttttttttttttaagctcattagctatcattagtgttaactgtattttatgtgtggcccaagacaattctccttcttccattgtggcccagggaagccaaaagattagacacccctgatttagacaaataagtgaaggcacactgaaataacaattatatataataaccttgtgccgcccagcgtggtggctcatgcctctaatctcagcactttgggaggccgaagcaggcggatcagctgaggttgggagttcgagaccagcctgacttacatggagaaaccccatctctactaaaaatacaaaattagctgggcatggtggtgcatgcctgtaatctcagctacttgggaggctgaggcaggagaatcgcttaaacccaggaggcagaggttgcagtgagctgagatcgtgccattgcactccagcctgggtgacaaaagcgagactctgtctcaaaaaaaaaaaaaaagaaaaaaaaaaaaaaaacaaaaaaaccttgtgttttatggatctcacattcatctcagatatttcttgccctgagagatcctctgaattctcaggattgcttcatgttgattctactgtgatcctatcaaatatagtaatgctagaaatataggtctgaagtttgggagagagattggctcagtatagatatgtaaagcacagttggatatgtggtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcggtaaatgtcgtatacaccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctacgaaaaatgcagataatgggcagttccacattggttgaactgccccaggcttctctcttctagagttgctgtcccttccttttaatcctgtagtagctcctatcactttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttacaggattttaccatgttgcctaggctagtcttgaactcctgacctcaggtgatccacttgcctcagcctcccgaagttctgggattacaggcgtgagccaaggctcctggcctcctgtcactttttataattgtcagtttgtttttcctctcagaaattaagctccttaaagctctctattattgttttgaattcccagggcctagcataatgcccagcacgtaatgttgaatgtttgttacgtaagtgattgaaggaataatccaatacatatctgtcttaagtacaaaagaattccaatatggtggtctcacagagtcaaaaaagcggaatgtttcagaaaagagggattgataaacagtttcaaatggtagtaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggggcgggggttggttttatttttaaagatttgtagctgagcgtgacagtatgtatctgtagtcccagctatttgggaggctgtggctggatgatagcttgagcccagcagcttgaggctgcagtgagccatgattgcaccattgcactccagcctgggtgacagagagagaccctaactcaaaaaataaaataaaataaagatttgaaactaaagggaagaaaccattggagaagaaagccaaagatctgacggaggagaattcattatcatggtaatgttatgcatttgatttgcatatatctaagtattcccaccaactttttttttttttttttttctgaggcagagtctcactctgtcacccaggctggagtgctggagtgcagtggcatgatcttggctcactgcaacctcccgggttcaagcgattctcctgcctcagcctccctagtagctgagactacaggcttgtgccatcatgccctggtaatttttgtgtttttagtagagatgaagtttcgccatgttggccaggctggtctcggactcctgacctcaggtgatcctcccacttcggcctctcaaagtgcggggattacaggcgtgagccaccatgccaggccccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaagagagggtctcgccaggcacggtggctcacacctgtaatcccaacactttgggaggccaaggtgggtggatcacttgaggtcaggagtttgcgaccagcctggccaacatggtgacaccccatctctactaaaaaaactaaaattagctgggcgtggtggtagatggctgtaatctcagctactcggtaggttgagataggagaattgcttgaacctgggagacaggaggttgcagtgagctgagatcacgtcattgcactccagactgggtgacaagagcaaaactctgtctctaaataaataaataaataaataaataaaaggtctcactttgttactcagactgaagtgcagtggtgtgatcatggctcactgcaatgtccgcctctcaggctcaagtaatcctcccacctcagcctccctagtagctgggactataggtgttccactactatgtccagctaattttaagaaattttttagtttttaaatatttttgtagagatggtggtcttactatgttgtccaagctggcctcgaactcctggtctcaagtgatcctcccacctcggcctcccaaagtgctgggattaccggtgtgagccaccatggctggccaaaaatgagtaatttttttttttttttttttttgagatggagtctcgctttgtcgcccaggctggagtgcagtggcgagatcttggctcactgcaacctcctcctcctgagttcaagcgcttctcttgcctcagactcccaagtaactgagactttaggcacgggccatcacagctggctaatttttgtatttttagtagagatggggttttgccatcttggcctggctggtcttgaactcctgacctcaagtgatccacccccttggcctcccaaagtgctgcgattacaggcatgaaccactgtgctctgccccaaaatgagtaatttaaaggtgactgtaatatagttaaacaaatgcctcttttcccattctttactaacttgttatttaaatggggcaagtttttacaacataagaaataaacaggccaggcgcggtggctcacgcctgtaatcccagcactttgacaagcagaggcgagtggatttcttgaggtcaggagtttgagaccagcctggccgacatggtgaaaccccgtctctactaaaagtacaaaaattagccgggcgtggtggcacagactgtaatcccagctaatcagggggctgaagcaggagaattggttgaacctgggaggcggacgttgcagtgagcctagatggcaacactgcagtccagcctgggcaacagagcaagactccatctcaaatgaaacaaacatactaaaaacctatttacttgtttgatgtgagtgtgcttagctttattccccttaaagagagtctttttttgagatggagtctcactctgttgcccaggctagagtgcagtggtgcaatctaggctcactgcaacctccgcctcctgggttcaagcgattcttctgcctcagccttcaagtggctgggactacaggcgtgtgctaccacgcccagctaattttttgtttttagtatagacggcgtttcacgctgttaggcaggatggtctcaatctcctgacctcgtgatccacccgcctcggcctcccaaagagctgggattacaggtgtgagccactgcgcccggcctaaagtgagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacaggtgaggtcattatggtatagtggtagcttattttataaagctaagttttgtttgtttttgtttttctcccacttagtctttgaagactctttagtcatttgcctcttctgagcgcagcataattgatccctttatcgcatctgcattgttctcctttccattgtccactctcctgcccattgccacttctgggcctctgttctatccttctcagctctgtcccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaaggtttgcgtgcctgtagtcccagctacccaggaggctgacgcgagaggattgcttgagcccaggaggttgaggctgcagtgagctttgattgggccactgcactccagcccgagcaacagagttagacctttctgcttctttacctaatgtctaataatgctgtgcacattgtatttttactgtgggaacagttattgatttctattgccttattatcaaaattatattaattacacttggaaatatggaaaggaaaaaactggtattataccaacttcatataaccaccaatagagttctagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccctacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattgctgatcagcatgagaatttttaaattgttatttttaattttttgtttgtttgtttaatagggacagggtctcactgcattacccaggctgatctccaactcctgggctcaattgatcctcctgccgcagcctcccgaagtgctaggattacaggcgtgagccaccgtgcccatggtatttttaacatgcccttgtttccaacctggaccagttcacccctccttagggaacctgtggtcctccactcccaggaggtcactatattgatggcaagcttagtgcagacacctgatcggctacaactctgaactcctgggctcaagtgagcctcctgcctcagtctcccaagtagccaggactacaggcacgcatgccgctgcacccagagagaatatttaatatttttttttttttttttgagacagtcttgctctgtcacccaggctggagcgcagtggcacaatcttgactcactgcaacctccgcctcctgggtgcaggtgattctcctgcctcagcctctcgagtagctgagattacaggtgtaagccaccatgcctggctaatttttgtatttttagtagagacggggtttcaccatgttggccgggctggtttcgaactcctgtcctcaggtgatccgcccaccttgtcctcccaaaatgctaggattacaagtgtgagccaccgtgcctggccagaatatgttttcaccgaacacatctaacattgtgttacatgttctttgttgatttaaaattgacacatggtgtattagagcaggaggaagttgattaagcttaataaaatatctaaagaaagaatgtgatacagaggaggtatttagaagaagaaaacttcgaagcaatattgataatcctaccaaatagtttacaggaggaatgagaaccttagctaatgtaccttggtgttcctgtaggattgtcaagtacaatcttttttgtttttttgagacggagtctggctctggcacccaggctggagtgcaggggcgcgatgtctgctcactgcaagctccgcctcccgggttcacgccattttcctgcctcagcctcctgaatagctgggactacaggcgcctgccaccgcgcgcggctaatttttttgtatttttagtagagacagggtttcactgtgttagccaggatggtctcgatatcctcacctcgtgatccgcccgcctcagcctcccaaagtgctgggattacaggcgtgagccaccgcacccggccgagtacaatcttttataaagaggtaaacacaagattgtaatgaacaggcttagcatagccacatcccactggcagtattagctaatattatttatatgtgattatattattggagattcaattcacctaactccctctgttctgattcagtgcttgctgaatacctctttgcttgtgatttggctttctagttgtagagctgcccacagcatgagaacaggctgaaatactgtttttttgggcaattaatgcctcattgtaaatgaaaaaaaaatttttttttctttaatttgtttcattagttgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacaacgaggtaacattctctctggtggctgaaatgcaatttacttaaccattttcctattataagacatttagatgatttctatgaacattttttttaaaaatcagatttttttgtctttttaagaaaaagaggacctagttcacttatttctgaataagtttcttttgtgtggaacagatggaaatgttgggaaaaaaaagaaatctacacttttctgttgtcctaatgaggcagtgaacttagttggatagcctgggtagttcatactacctattgatatatacccccaaacagaaatcttcctttttttttttttttttgagatggagtcttgctctgttgcccaggctggagtgcagtggcgcgatctcggctcactgcaacctctgcctcctgggttcaagtgattctcctgcctcagcctcccaagtagctgggactacaggagcccgccaccacgcctgactaatttttgtatttttagtagagacagggtttcaccatattggccgggctggtctcgaactcctgaccttgtgatctgcccacctcggcctcccaaagttctgggattacaggcgtgagccatcgcgcccggcccaaactgaaaaattttaagtaacagatgtattccagaccttgttgaataccaacacagcagacagtttgctattataacttctagcaatagaatgaagagatgccaaaaataaggattacctaagggagactactgactagaattagaagaagatgggaggcttaacattgggaaacaacagtgtttaaaggacaaacagaataaggactaggagctggggcatgtcagtgagagggtaggaaggagccaggaggccagggcgggctacccatcccctccatgcaccactagtgattaccatgtcactaatccaacatatgcttcacagtcctagctttcagaatgctctccttgaaatttctcgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgatgaatgactcattagcattgtaagaaatgggttgcaggcgggacaagcacctgttgggagggaaaggaatgtgtaatgtaaaacagtagtagtggtggggcatgggcacatttaagcagcagaggggtaggtgggggctggtggcaaggagtgggaagggagaggcaagatgacttcagatgttagtttacttgattagcagcatagcgtcaacaaatgagttgggcgctatgaaaggaaaagcaggtttggacattgctgagtttggggagccaatggaatatccaggtgggaatttccattaggcagttgtaggtaaaaggttcaaaagctgaggaaagggtctggaatctaaatctgtaagtaatcacttggaatttatacatccttggttttctttcctattatctctacattatttcactattgttaatatatgtttatacctctgacactgtatgctgattagatcctgccttagagatagctcccttcccctctttctctttacagctcacacgttttgctctacctacaattgtttctacctgttggtatgtttagttctacctgattctactctatccgtcttagatatacagctctctctttccaattggaaaatgttccctacctccaaagtctttcacttttaacttatgtggaagataattatagtgctatttagggaaaaataatcaagtgtgttaagaatgccttatattcagatatatttatagtagaagggaccagtgcatactgaatattattactctcctaggcactacggctttggaaccactactttgccttctggtcctaaaaaaaattatttttaatgtatcagaaatatacatgataacattttccttatgtaaataaaaactattaagccttttttatatagagcagtggacttccatactgctatcatttgaatataaagaagcaattttgttaatttacctagatttagattttagatttgctgttttcttatttcgtgcctttaggcaggttatttaacctatttgatctctacttgcttggtatatgggaggcatgcatagtattttgttgtgactagtaggttaaccacattgtgaaggaatttatggcatgatcagaacgttttttctctctctagatgttgttattcatgaggaccaatggattggcgagacagtactacaatcaacatttagcagtcagttattaaatcttgggagttattcatctattcagcctgaagaatgtaaggcacattttaaatgaagtaatgtagtagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggccatcagtatagtggtggttcttcaccttttagggagtcagagacctctttgagaatctatagaccatttctccagaaaactggacttatgtagataggcacaaaattttgcttataattctaaagcattccacggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctcctctaggaaataaaataacataaaaaaaagaaagaaaacaaagtaagggaaacagtataaacttgtggttatggtcactggactcagatagaccaggatttgaatactggccctcttacttccagtctttgtctttaggcaatgtatttcacttcactatacttttgtctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatatatatatggaagatagagcatggaattccaatctttgaattcttaaagaaaggcagagcaagtagaagggaagagcaacaattagaataacaagaactgtgtttggaatgggcaaggtttcattatatactagggtggcccatcagcagaaaaccaactctgacatatttcatagacaactaaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatgtgcaggtgataatgagtgctatgaaggaaactaacaaagggttaagatacagaatgccgtggttctagttgagaaggattgatcatggagtagaatcagggttaggaagttgttacaatagctgcagttgagagataatgggaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatacataaagtcccatgaactcttcttctagcttctcccaatggtgatatcttatataactttagtacaatatcaacaacaggaaatcaacgtttgtataatactgttaactagtaatatactaggatactttccctttcagtatcaataaatatagtatcagcctggcacagtggcttatgcctgtaatcccagcactttgggtggctgaggcaggaggattacttgggcccaggagctcgacaccagcctggatgatatggtgaaacctcatctctactaaaaatacggaaaaattagccaggtgtagtggtgcacacctgtagttacagctactagggaggcttaagtgggaaagaaagttgaggctgcagtgagccatgattgtaccacagcacttcagcctgggtgaccggagtcagaccttgtctcaaaaaaattttttttcttaaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgggaggccaaggtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctgggaggtggaggttgcagtgagcaccactacactgcactgcagcctgagcgacagagtgagattcggtctccaaaaaaaaaaaaagaaagaagaggcatttgaatggataaagaagaatgaaaattatttctatttacaaatgctctgataacatacctgaaaactccagggaatcaaagttaaaacaaatttaaataataagataattcagtgatataacagaatgcaaaattagtgttaaaaaatatcattaggctgagtgcagtggtttgcgtctgtaattctagccctttgggagatgaaagtgggtggacagcttgagcccaggaattcaagaccagcctgggctacaaaaaagaaaaagaaaaagaaaaaaaagctgggtgtggtggcacccacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataatagtaattagacttaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaagaaatggaaagacattccctgttcttggataggatgactcaacattataatgatgtcagttcttcctaagttaatatgtaaattcaatgtagttccaatgaaaatatatatgttatggcatataaaagttgatactaaagctcataggggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaagaaacctgaatgaatcctctgtaatcttggtgtagggaaaggctttttcttaatattactcagaatccaggggcagtagaagataaactgatacattttactatagaaaaataaattttgcataaccaaaacactataaacaaagtcaaaagacaactgacaaacttggagaaaatatttgtaacatacaacaaaaggctaatatccctaatatataaagaacttttaaaccctgagtgacaaaggctgggtgtggttgttcacactggtaatcatagcattttggaaagctgaggtgggagaatcacttgagctcaggagtttgagtccagcctgggcaacatagtgagaccctgtctctacaaaaagtcaaaaaatcagcccggtgtggtggtgcatgcctatggtcccagctacgttggaggctgaggcaggaggattgtttgagcccaggaggtcgaggctgcagtgagctgtattcatgccactgcactctagcctggcaaaagggaaaatgtgaaaaagagatgaacagtcagttttcaaaaaaagatataaaaatggctatcaaatataacttattagagaaattcaaattaaaactacatggagataccatttctcacctatcagattggcaaaattaaaaaaaagcacattctgttggcgcaactgtgaggtaatgtgccctcttaatacattggtggtaggaatgcaaattgctacaacccttgtgaagggatatttggcaatatctaacaaaattacatatgtacttagctttcaacctagcaatcccacttctaggaatctaccctgaagctacacctccaacaatatgaaaatacatatcacaaggttattcattgcagtattgtttataattgcaaaatatataggagaatgattcactaagttatgctacattcacatagtggaacactatgtactatgcagctgtacaaaaagaatgaaaaagatctctatgaactgatatggagtgattcccaggacatactgttatgtgaaaacataaaccccccaaaactgtatgtagtatgctgtccttcctgtacgaaggaatggaggtataagaaaatacctcggtttatttgtggaaagaaaatgcaggaaggataaaccagaaactaaagagattggtcacctacagggggcacataggagaggggtggaagaaagtggggaatgggaacaggatagcaggggtcaggaggaagtgacactaacaaatgaatgtaatattgttacaagtgaacctaatattgttacaaatgaataaaataactacacagaagcgggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcatctgtaaacattttcttttcttttcttttcttttcttttttttttttttgagatggactcttgttctgtcacccaggctggagtgcagtggcgtgatcttagctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctaacctcaggtgatctgcccactttggcctcccaaagtgctgagattgcaggtgtgagccactgtgcctggcctctctttttttttgagacagggtctggctctgttgcccagtctagagtacagtggtgtgatctcggcttactccaacttctgcctcctgggctcaagccagcctcccacttcagccttccaagtagccggtaccatagctgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaacagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgacataaagatatatgtatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccgtctctacaaaaaatagaaaaattaaccaggtttggaggtgtgtccctatagtcccagctattcgggaggctgaggtgggaggatagattgatcccaggaggttgaggctgcagtgagctgtgatcatgccactgcacttcagcccgggcaacagagtgagactctgtctcaaggaaaaaaaaaaaaatacaaaacacaaaaatagagaattaccatcaggcagagatcacaataataaatactgcactgacacaaatgcactgatagatgctaaaattagtaggtgaaagtttgaggagagagagcattgcatagtctcaaagtatctccccaagataccagcatactagagggaaaataataaatttataagaaaactcttcagacaccaagttaactgagtgattgggataaatatcaccagtaataagatgtatggtatcataaatgctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatatgaggtgggatcttggatgaaatcctacatagaaaaaggatattaataggagaattgataaaatttaaataacatctacattttatttaacaatatttaattaacattagtttcctgtttaagataatttataatatgtgagatgcccacattagtcgacatagtgaggaatataaggtaactctgtactatttttgcaacttttttgtaagtcttacgttagttcaaaacagagtttttaaaaaagctgtatacgatcatctcaataggtacaaagaaagcttttgataaaattcaacacttgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccgtattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatctttgtttttacacatacacaggaatttatggtgctttattttttacaggttagtagctaaataaagtatattctaaagttttttattgatgtagggaaatggctaccagtggacattttgagaatattgcagttgtttttcttctgaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatggctcactgcagcctcagtctcccaggctcaagagattcttctacctcagcctcctgagtagctgggactacaggtgcatgcccccatgcccagctaatttttgtattttttgtagagaccaggttttgtcatgttgcccaagctggccttgaattcctgagctccagtgatcctcttgtcttagcctcccaaagtgctggaattacatgtgtgagccaccactcccagccccagaacaactattattaaaaagtcaaaaaacgacagatgttggtaggctgtgtagaaaaggaaatgctcatacactgttggtgcgaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcagtggctcatgcctgtaattcccacactttgacaggctgaggcaggcagattgcttgagtccaggagtttgagaccagcctgagcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaatagagtgacaccttgtctcaaaaaaaataaataaataaataaataaattgcagcaacacagatgcagttggaggcaattatcctaagtgaattgagggaggaacaggaaaccaaataacatgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacaatgtttccatgaggtagactttttttggaatctaaataaccatgtgtttccatgtaaatttttatgaatcagggacaaatatataatttgatgttagagatgtttttgttccccaaaagctctatcttgttcatgaaaaacgaagcccagagaagttatgtacaagttcacagagcttattattgacaaaaccagaatttgaatacaactcttctgattccagatttgctggaaatactgtgaaagaagaactcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaaacacaaatcagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacaggtaaatattttgactgcctccttaattttagattatgaaaaaattaagatacaagaccatcttagtgtaccatttggttatcactatatatgtatcatcagctattaaagtatggtatcacgtgtgatagagtaatgccaactaaggtactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaagtcttaaatttattcccaggtatactactttacccttttagtgaagatcttacctccttcaaataatgttctttaaacatttaattctggagaagcttctacaattttttttcagccagagtactctgataaatgctatggttataaggcagatgtcaagggagttaccttaactctttcaagtcacaattaatgttcaataaattactgtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaaagacagtttcatttgtggcttatgagttatttttccctgctaaattaatttagagattgattcagtatattattattttttacctgaaagagttaatgtctctccaaacttctgccttccaaatagttatttgtagataggagctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagccgtaacaaagcagattgctccatgtttaatgtgaatattcttttaaaattaatagttttttggttaatagaagagaaattacagttgtctctaggtgattctatggtgtttaggttagtattgaaaacatatgaatccaggaattaagatgttgttgttctttgtacattcattcatccagccccccttatttataaccatcattttaaagttttaacatctacttcaatacctcacatcagtctttttaagataaaaatcccaattttgaaggattacttaagtaattctattttcctgattttacttttcttttcaagagaccaaccccatttccaaattcccagcaaagagaatctgattgcccagagtaaatttgattcaaaaaactgtgatcaggaagacaaggtcacacaatacaaatatgagagcttgagcttatttcagtggatgggaaaacagttaagggagtcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagttcaagttctcatcttaaaaaaaataaaaaataaaaaaaaattggattgtaaaacttcacgtatagaaaatatgttatcatataataaatatttttatgtttatataagttaatacataaaaattttcaagaaaaccctttatatataatagtatctcattttaataaaaatgtatctataagtacatatgtgcatttgaaaacctggaaatatgcatgtatagcaaaatgctagcagtggttatttctgtatggtagtattatatgtgctttaattttttctttatacctttagtttgaatttcatatgtgtgtgagcatctgcatttacttttaaaaacttctattataaaagccttcaagcatatataaaagcagagagaatactaagcataaggcactttttttttttttttttgagacagagtttcattcttgtcacccaggctggaatgtagtggcatgatctctgctcactgcaacctcctcaagttattctcctgcctcagcctcccaagtaagtggaattacaggcatgtgccgtcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttaggtacctattagccagcttattaaaacatggtcagtcttgtttcacctgttacctcccttgtctttactgtttaaatatttcacaataaatatattttattttataattaaaaataaaattaaaaccttatgctttttaaaataaaagaatagttaatgtttggaaaatctagctaacaatgtgagaaaaaatagaattaaatttatactttatgtttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaaccaaaaaaaaacagaaaaaaaattacattgtcagaaaataatgcagtaagcaaaagacacatatctatagagataaatggggaaaggatatgagtaggcaagtccccaaagaagaaataaaaatggccaataaatatatggaaaaattgttcttacaagtaattgaaaacacacaaagtaatgatgatagatgatttttcttttaagaaattgatagagaagatatgggaaaacagctactgtcatcagctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgctctgtctttacagatttactgagatgtttgatgattttccaccaaaaaaaaaaaaaaaaaatctctagtgaaagaaactaaggagatgagcaggtgtagtaaattagatttatggcctgaagtgagaaactaaaaagacagctgatgttatcagaaaaattagtgctaagaaaccctcttttgttttattatagttttgaagttgaatttactaatacagaatatgataatacagataagttgaatttactaatagagaatataacagtaataaggtctgtgttattgtggctttaagtattagaattgtggccggcgtggtggctcccgcctgtaatcccagcactttgggaaaccgaggcgggcggatcatgaggtcaggagatcgagaccatcctggctaacacggtgaaaccccgtctctactaaaaatgcaaaaaaatttagccgggcgtggtggcgggcgcctgtagtcccagctactccggaggctgaggcaggagaatggctagaacctgggacgtggagcttgcagtgagccgagattgcgccactgcgctccagcctgggcaacagagcgagactccatctcaaaaaaaaaaaaaaaaaaaaattgttactgagagttaaaaataagtacaattgtgtctaaatgctttttgttctagaaaagttaactaaaataactattgaaatatgagtgaaatattagacttgggttcatttcagtgtcctttctttaacaaaacaaaacacaactttgcctatagatagatacatgagaattttctttacagaaagcagttggttattataaatgatgaccgttcaggagggcaaggaatctttagaaaatattttattaaaattatctctggtggcccggcacggaggcttatgcctgtaatcccagcactgtgggaggccgaggtgggcggatcatgaggtcaggagttcaagaccagcctgaccaacatggtgaaaccctgtctctactaaaaatacaaaaattagccgggagtggtggcacgcacctgtaatcccagctactcaggaggccgaggcaggagaatcacttgaacctgggaggtggaggtttcagtgagccgagatcacatcactgctctccagcctgggcaacagagtgagactctgtcttggaaaataataataataataataataatctctagcatgcttctgttgtcttaatgcatcattcatattttgtctctgtttacccaaattctttagtgataaaagattagattcaactgacttaatcagatcaatctatttaatctgatactaagcctagatttttttcctttttggtgacttttgtttttactgttttttttaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatctttatatacataaattctgctatttttatttcttttgaaacagggtcttgctctgttgctcaggctggaatacagtggtgtgaacacagctcactgcagtctccacctcccaggtttaagtgattctccccgttcagcctttcgcgtagctcaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataattctatataaaagtgaaatataaatctttgcaaatatctgaactagattccagtagttttaggaactatgtgccaggaaccagggacaaagagcaaatacctattttttattatatgacaagtgggagcagaaattcagttccttactttatcttggccaaatgccagattaaaatgttactagttgggttaattcacatatatgtataaatatgttttccaatatatgattgaaggttagcattgttatatcataaaactatgctaaggagaatacaggcagaaaacaaagacaatacctctcaaaaaacccaacttttaattgaatacagagatttcattctcaaagaagagctccttattcctagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctacattactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccatgctgatgatgaaagattctgaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctctttcattctctttatgttcagctatgagggctgaattcatagtttctgtcatagtgtatgtgtttttaagacaaaaatggggagagaatatgaaaacacaaggaacttttccctaacctattttatagttaaacaaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcatgaccttttaattcttttcaagagttgtgtaaatttacaaaatgataggattatgtgaacattcttttaaaattattgaattattaagaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaatcagccaggcatgatgtcgggtgcctgtagtcccagctacttgggaggctgaggcaggaaaattgcttgaacgcaggaggcagaggttgcagtgagccgagattgcaccactgcactgcagactgggtaacagagcaatactctgtctcaaaaaaaaaaaaaaaaaaaaaaaaaaagactttttgagtggagggaggagagcaagggtttaaaaactaactgttgggtactctgcctactacaggagactctacttgggtgatgatatgcccatgtaacaaacctgcacatctaccctctgaatctgaaataaaaatcgaaatttttttttttacataattttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaaaaaaaaataataataattttgtagtgatttgacatgtctttggaaagatgtggtattgaatcttctacagtttgttacatattcgatcgctacacactcctgctaactcatgtagggatatgtgacacaattggaagagatgatgaaaccatctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaggaaaactcatagacctcaccagtacacagtaagacgaaagtaaattaggaaaaaataatgtctgggagatagtagatattcagtatttgtttactggtgaatggatgagccattagcagtgaattatgaatatgcttgaggtttcttgtgagtcacctgagaaacgattaataaatgagaactttttataacccacacccagagtatatagatgataatggtgagcggaaagttggaaaaaagtttaaaagagaacaggctattgatatttttaggtagagagaagaagaaaagttcacctcctatttggcttttttttttttttgagacggagtcttgctctttcgcccaggccggagtgcagtggtgcgatctcggctcactataagctctgcctcccgggttcaagccattctcctgcctcagcctcccgagtagctaggactacaggcgccagccaccgcgcctggctaattttttgtatttttagtagagacagggtttcaccatgttagccaggatggtctcgatctcctgacctcgtgatctgcccgcgtcggcctcccaaagtgctgggattacaggcgtgagccactgcgcccggcccctatttggcttttcactatgatcagtttaagagaagacagggcaaggagagaggacatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacatccctgcccttagattctaggaaaatagtaaagaagacgaagaacaagacctcagtgtatccttttactacaagtgactgtaaatcaactataaaattagccatgtttgtaaattaaagttataattttggcccaataatttataatatatctgtttgttgtttgtaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaattagtctgtaaacccttactttctaaaaataattaactagagctagtcgaagagaataaaattttccgagtgatagatagctatttatggaagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatagaatttaagggctaaaagtatcatatgatctcacctctgagttgttgtggaagctagtaagacatttaaggtgttttcccacctttaccttagaaattaaagctagcaaataaatgttgtatggtaaaactgctaatcagctcagtgaaaaacacattgttttttgaataataggtagtcaaaagctcagatatttttctctttacctcataaattacatgtgtttacaaaatagcactcagtgttttatgctccttatgattatttctaaatattgcggtatctaaaaaccaaattcagatatattccacatgttatcatggcatacttcaagaaaagttatagaagcttaatttgtaaaccttatttctctttacagatattatgtttgttataaataagtgaataaattttgctattactgtgaaagttgcttttgtggaaaagaagattgaattaagatgtatggtaggctgggtgtggtggctcacgcatgtaatcccagcactttgggaggccggggtggggggatcgcttgagcccaggggttcaagaccagcctgggaaacatagggaaaccccatctctaccaaaaaaaaaaaaaaaaaaaaagctgggcaggtgacataggcctgtagtcccagctacttgggaggctgaggcaggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatgtcattccaaatgtttctattcaatataagcatttattggacaaaaatgttgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttacaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagtgcagcctaaaagcctttaaattgttattagagtccagattatatggtttccttgaaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatatgtactgtggatgttatactagttgacctaagtagacttattgtgcccaagaagcttggtagtccatttaagaaacacttaatgaacatttgtgtggcataacagtcccagactatgagtgggttgatcatattttacattggttgtaacttggagctgattttccaatggaagcaacattagatattgcattggagtctcatacgaggccacagacatttattaaattaacatgtagatagcatagttcctgttcttcaagctatcataaaactcaaataccatttttaacaatgtttctacagaatattcagatttacatttttggaatacaagaaatacatttatttttctgtactagaagcaaaaaaccccagcaggtcaaaccacaattaaggctcctatttaggcagcactaggaaatgtttgggtctctcaagaggttatagtcaaggtgtaggctggggctgcagtcatctgaaggcttgactggggctggaggattcatttccaaagtggctcattcgtatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagttagctgtgcgttggagagtggattagaatgaagctagtgcagagaagcggtaagaggctgttgccttattttggaggggagatgatggtggcttgactagagaggaagtggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatgttgatcatattgagcttgagttcctgagaggtaacaagttggaaagtggttagatgtaaagaaatgcaatttgcaagagaagtctgggctaggcttataaggttatttgtggtaattgaacttttgcttggtttctgcaccctgttttgtttttccttcttaatcttcagtgattacctctcataatggattattctcactagcctataaagacactcccatatttcttttattaaaaaacaaacaaaatcatccattaacattacatctccctcttgtcccttcgtttttctattctgttttatacccagccaaactttgttaaagagttttaaatatactctctctcccctattatgtcttcagtttcacttcagttattccattctactcctaccatgctgcagaagctgcttttgtcaaagttacacttttgatgttgcctgaggcatggatacttctttcctcactctaactgctctcagttatattcagcatgtcagtccacttcctccttcttgaaacagcctcctccttgctttctaacctgtctctcaggcccttctttctcagcctcttctaccccctctttaaatgctggggttaatcttgagctctcgtctgcgtccttcctcttattctttctgtacattctgcctggatgatcacagctgttttcgtatttgtacttaacatcttcaccctgattttctcctccaggctccagtagtcaggtatcaaattctttgcttgacgtccatctcacatttaaacatacccacaatagactcttgtttttcctaaccacactcaaatctagttctcttcatttttatactttctggaaaatggcacaccatctacccaattatttaggctggaaacctgggcacaatcgtcgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctacgacctgttgcgcaaaccagcacaccagcagtctcttggtggggctcctcctggccttgcctcctcccctttattctctacccattggcagtgtgattaccctttgcctttgcttcacccatcagtcgtctccttatgcttgtttcctctgcagtctcatctgctgccactcccctgtcgtccagcactctagccacgtggccttctttcagttcttcattttgatttttctccttaggatgttctcgaatgtcttccttctgtctgactccacaaggctggtttcttcatgtcttagattaaatgctgctttatcagagaggcctttcctaaccactcttctttattttctgttatagtagcctgggtgtgcttactgtaatttgtagttgcatactgtcttttctagaaaacatttttactgaagttaaaattcatataccatcaaattaatcttctgaaatgtacaattcaatggctgtagtatattcccagggctgtgtagctatcaccacaaccagttaggacattttcgtcacccagccctttacaaagcctcatactcattagcagtcactctccattccccatgcccctcaacctatggcaactacgaatctgctttcggtctctatagatttgcctgttctagatattttatataaatattatataatatgtgatcttttgtgactggcttcacttagcatgatgttttcaaggtccatccatgttgtagcatgtatcactacttcctttttattgcaaaataatattgtattgtatgcatataccacattttatttatccattcatcagttgatggacaattgggttgtttctactctttggctattatgaatgatgctgctgtgaacatttgtgtacaagtttttgtgtggatatgtgtgttcatttctcttgggtatatatttaggagtggtggaattgctgggtcatatggtaactgtctgtttaaccttttgaggactaccaggctgttttccaaaattgctgcacaattttacattctcatcagcaatatgagggttgtaatttccccatattcttgccagtacttcttattctgtatttctttttgttgcatgtgctttcgggtcgtatctaagaaaggtgtcatttctaagccaaggttatggagatttgctcccgtattttcttctaagagtttagtagttttacctcctacatttaggtttattatctactttgagttaagttttgtatgtgggataaggaaggggtgtaattttattttttggcatgtggatatctagttgtcccagcgtgaatttttgaaaagactgttccatccctgtttagtcatcttggcaccactgttgaaaagcttattttctttcttcttctttttgtagagatgaggtctcattgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttatatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgtcacattaaattcccccgctaatgagcctgtttctgaattctgttctcaatttattttttaaaaatcaatgtagttataaaataggtaccacatgccatgattaaaatgcacactacataggaggttacaaaacaaagagtgaaagtctccttcaccatccaaccctctctcaccagtgctgcttccattgctggtgagaaggttttttgtatgtccttccagtgatttattatgttcatcccagcacatgtgtatccctttctttagaagcatgtggacagaagaatattgttcatgttgttgttccctagagtctatcctggtgctccttccctaatagcacttgcaaatgttcttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaagtagaacagtacaaactgaggtaaatagtatttgtacctggaaacaggcatgcctctcggtcctttactggaggtgaggggtgagcaggatggtcagtcttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccacgttcttgcacctccccaagttgcacaagcttttgttggttgttatttggtgcatcctaacctggtgggcgggagcagggttgttcctctttgattctggtccagccccagtcttatacaggatgttgaatatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggggttttttttcttttttctttcccccatctgtactggttcctcacctgtaccctggggcaacaggatttggtgtccctcctccagcagttgaaggcttttgttccttaaaggggaggccagatggtgctttgtgttttgtagttggaagctttctctgatgtcttgccctgcccccagtcttatgagcacctggtggaggtgagactactatgtggaagagcctgtgaggatgcagatgttccttatgttgctgacactggcagttcattggctttttgcaattaatttattaataaaaattaatcacattcttctttcctgcctgtatggaggacctgtcttcttcccaaggcctgccccaagggaaactgtgctcctgttccatctccctggaggcacctgtctccttatgtttcagtctttttggctgttttacaaccttggttctcatgtgtattcaagaaaatgatgatttgatatttattcaattttttccagtaactgttagggtaggagccactttttccagctttctacatcttaattagaagcctctctccgtttttttcccccattttctttatttcatttttattcttttggctattttcattccttttcttaatgttacttatatattttcagtgtaatctcttcttttttttttttttttgagatggagttttgctcttgttgcctagactggagtgctgtggtgcgatctcagttcaccataacctctgcctcctggattcaagcaagtctcctgcctcagtttcgcaagtagctgggattacaggcatgcgccaccatgcccggctaattttgtatttttagtagatatggggtttctctatgttagttaggctggtcttgaactcccaacctcaggtgatctgcctgccttggtctcccaaagtgctgggattacaggcgtgagccaccgtgtccggcctatctcttcttttttgcataatgtaaattagtctttatctcttagagaagcatcattctcatatcacatatacttcagtgttttgtccattcttgagacaattaaagttgtactacttggcattaattagattgtgatcataagtcaaaatgtcattggttataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggttgatggtgctctgtcattctggtattgaacaacctgccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcacttttctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagacagagtcttgctctgttgcccaggctggagtgcagtggcacaatctcagctcattgcaatctctacctcctgggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 2197 - DNA, 103893 bp, Homo sapiens
cttccaaaacaaaagttctttattaattcttcaagaaatctgttttttacttagtcgattaatgtccatctcatgttgcctcaatagcccatgtatgaatcactcttcttgcagattttgttcagttttgttgtatgtagacccatctttctttgagttggtttctttgattgagttgatttgtctgtattaaaacccaaacaatacctaagccaaaaaagcaatgtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattctgtacaagagataaggcaggtactgctaaatgataacttagatgcaggggccatcatgaaaatattcatcccatatcttacattaagcaaactactagcaactgtttgttaaaaagtataaatgaataaatgaaaataggacagataggcagtgtgggaagctaaaatatggaagtgttattgctttgctttatgtggtataatgatctgattttatcttcccagctctcccaggaagtatgcagaataatatttatctcatattgtgggtgtggcaatcaagacagagaggctagatgctttacctaaagtcatccaacaaatatttggtagaaccagtgctagaatgcaataaatggaaacagagtttatttcggtgtttcttttcctgatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaacgagatatgaggagcagtctactggggagtttctgggaaagtttgtttttcttgtcctaataaacaaacaaataatggggtcactggattggagatcctattgagtcaaaggaatattgaatttgacacagtagaatagtctggaaggaaaggaaatgatattcagtaaatgaaatgctgaaaattgatattatgaaggtggcgcagtagttgttattgattaaatgaaacagttgagattaagaaagtttagccaggacaagttatatagcacaaatcatttcaggtaaggaagttaaaaaaaaaccctgagaggctaggaagtcctggctccaaactcctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgtaaggaagggatcactagcctgggcgttagcatgtccgaatatgataactaaacctgctgcaattatcttgcaaccagggaggagctagcttgaaaataaagccaacacagatgacaagcagaaagtggaaagaacctaagtcgttgatgatgctattgagctgatgaattaaacctggagtgtatgttccatgggcttctgtaaggaattaaaatatttttactgtttaaaccagtgtttcattgttttctgcagaaatcctaattggcataaagaaactattgaccgactaaccccactgcaacctcacctgaccccttaggatgtcctttcatgattttcttgattttgttgaagttacgtattgagaataatggaaaatcacagaaggtgattttctgatcccaactccttagctatgaccttgtgtctctagctcatgatcatggtttatgaagcacgggaaggactgggaaaagtagaaagtaggtaggtaagatgagatgtctgatgatggaggttattggggtcaggacaggtggataggcaagttgaagtgtgtaagctaagcaggaaatgcaaatgaaaatcagagagaaggtaccccttcagaacagattcttagaaagccattattagaaacatatgggccacatctttgagaaaagttgtggaattcacattacagtaatggcatcacttagattcatgctcttctctcagggagagaaatcaatatttataggatatcaaagggtcttcatcatgtgtctcagtctgtttttattgctataaacaaatacctgaggctgggtaatatataaggaaaagaggtttatttggctcacacaattctgcaggctgtacgagaagcatggcaccagcatctgcttctgttgagggcctcaggaagcctccatcgtggtggaaggcaaaggggaacccgtgtgtcacatgatcagggaggaagagagcaagagaggggaggaaggtatcagattctttttaacaataagatctcacaggaagtaggagtgagaacataatcccatgaagacagcaccaagccattcatgagggatctgcccccgtaaccaaaacacctcccagtgcgccccacctccaacattggggatcaaatgtcagcatgagatttggaggagacaaacattcaaactttatcattgtgcttgttttcttcagaaatagaccgaattgatatgtttcatgatgacattatgatctaaaaatgagagtttatttcagtttgtcctgtatacacccaagaggtccaggatattattctgtctgtctaccacaagtcctgcaaactagaagatggccttaacagtcaatctagggtggttctgcccaatgaccttttgtctttcctcagtgtcttccaaagcacatagtaatattctatcatgaattatatgaaagctgtttacatggattaaacagtaaatctgacaaacaggctgctttttgatgactctagacatatttcttcttacattttagacatttgagaaaaaaagtcaaatttcttaatactttatgttcaattgagtttgaagccataaagaggaaggaaataataaggattagagcaaaaataaatgaaatagagaatagaaaaacaatagaatcaatgaaacaaaaaattagttctttgaagagatcaacaaagttgacaaagctttaactagattaaggaaaaagaatactcaactactaaaatcagaaatgaaagacactactactgatttataggaataaaaaggattgtaagagaattcgtataagagctatatgtcaaaaaattggataacctagatgaaacagacaaattcctagaaacatacaaaccaacaaagttgactcaagaacaaagaataaatctgaatagatctataaaaagtaatgatattcaattctgattgaatcagcaaccaaaactctcctaacaaagaaaagcccaggaactgatgacttcgctggtgaattctaccaaacgtttagaaatgaattaacactaatccttctcgaactcctccaaaaagttgagaaacagaaccctttctgagtcattctatgaagccaacattaccctgataccaaagctagacagacaatacaagaaaactatagccaaatgtcccctatgaatgcattatagatacaaaaatccccaacaaaatactaggaaattaaattcagcagcccttaaaagaattttacactatgaccaactgagatttatcccagaaatttaagagtggtttaacgtatgaaaatcagtcgatgtaatacaccaagtaatagaatgaaggagtgaaaaactcatgatcatctcaattgatatagaagaacatttgagaaaatccattcctcctttatgatagaactgttcaacaaaccaggaatagaaaggaactgtctcaacatgataaagaccatgtattaaaaactcacgactgacatcattctcaatggggaaaaatttcaagcttttccactaaaatcagaagccatggatgcctgtgtttgccacttctattcaacatagtattggcagttctagccagacccatcaggcaagaaaaagaaataaaataaatccaaattagaaaggaagaagtaaaactatctctatttgcaagtgatataagtgtagaaagccctaaagaataccaaaaatagcctcttaaagctaataaacaaatttagcaaggctgcagaatacaaaatcaacacacaaaaatcagtcgtgtttctacacactagcagtacaaaatctgaaaaggaaattaagaattttttatttacagtagtacccaaaagaataaaatatttagaaatcaatttaaccaggaaggcagaagacttgtacactgaaaactacaaagcattctggaaagaaattaaagtagacttaaataaatggaaagagatcctgtgttcataagttggaagacttaatattgttaaaatgacaacgctactcaaaatgatatgtagagtcaatgtaatcacgctaataaaatcccaacagcgcttttggcagaaatggaaaaacctattctaaaattcatataaaatttcaaggaacccaaaatagccaaaataatctgaagaggaacaaagttgtaggactcacattttctgatattaaaatttactacatagctataataattgaaatagcatggacttggcacagaggtagacaatatagaccaatggaatagaatcgagaggccagaactaacactcacatctatgggtaattaattttcagcaagggttccaggatcactcaatggggaaaaggacaatctcttcaacaaatggtgttggggaaactagatatccacaagcaaaagaatgaagttggacctatacttttacacaatgtacaaacattaactgaaaatggatcaaagaccaaaatttaatgctataaaacacttaaatattaaatgctataaaactcttagaggaaaacatactgaaaaatcttcatgaccttgggtttgacaacggtttcttaaatataacatcaaaagtacaagtgatgaaacaactgataaattggacttcatcaaaattgtgtatcaagtgacactataaagaaagtgaaaagataacacaaaaaattggagaaaatgtttgcaaatcatacatctgacaaaaaactaatatactcaggcatttctttatggcaatgcaagaatggcctaatacaatacccaaaagaattgaatgcataaagaatcctacaactcaacaaataaaagataaataactcaattttttaatggacaaaatacttagacacttctctaaaaaaaagacatgtaaatggtcaataagcaactcaaaagatgctaaaaccacaatgagataccactttgtacctactagaatggctataattagaagaaaaaataactagtgttgttgaacatgtggagaaattggaaacctagtatactgctggtgggaatgtaaatggtttaactgctgaggaagatagtttggcaattcctcaaaacgtaaaacagaattatcacccagtaattctactcttaagtatataccggatatagtttgactgtttgttcctatgcaaatctcatgttgaaatgtaattaatctccggtgttagagttggggcctggtgggaggtgattggatcatgggagtggtttctcatgagtggcttcaccatctctagctgtcatcaagattgtgagttctcacaagatttgattgtttaaaagtgtgcagcacctccccacttcctctcttgctctggcttttgccacgtgacatacctgcacccactttgccttccatcatgattggaagcttcctgaagcctccctggaagcagatgctgctatgcttcctgtacagactgcagaaatgtgagccaactaaacccttttttctttggcacttacccagtctcaggtatttctttatatcaatgcaagaatggcctaatacaatacccaaaagaattgaaaacaacaacttaaacagtgacttgtacactaatgttcatagcagcattattcacaatagacaaaaggtagaaacaaccaaaatgtctatcaaaagataaacggataggccaggcacgatggctcacgcctgtaatcccagtactttgtgaggccaaggtgggcggatcacctgagttcaggagttcgagactagcttggccaacatggtaaaaccctgtctttaaaaaacaaacaaacaaaaagataaatggataaacaagatgcagtatatacatacaattattattcagccatagaaaagaagaatggaatactgatacatgctataagatggatgaaccttgaaaacattatgctaagttaaataagctagacacaaaaggatagtgtatgataccattatgtgaaatatttacaataggcaaattcatagagacaggaggtagattagaggttaccagaggttaccaggggctggaaggagaggaaaatgggagtttttgctgaataagcacagtttctatttggggtgatgaaagggctttggtaatagatggtggtaacggttgcacaacattgtaaatataattaataccaccaaattgtacagttaaaaatgattaaaatggcaaattgcatatgtctttctccgtttgtgttgctataaaggaatacccaaggctgggtaatttataaagaaaagaggtgtatttagcttatgattctgcagattgtacaagaagcatggcactggcatccacatctggtgagggcctcaggctgcttccgctcatgtcagaaagggaaggcaagccaatgtgtgtggagatcacatggtgagagaggaaacaagaaagaggggggtagtgctaggctcttttaacaactagctcttggccaggtgaggtggctcatgcttgtaatctcaacaccttgggaggctgaggtgggagaatctcttcagcccaagagttcaagaccagcctaaaaaaaaaaaaaaatcccataaaacctagctctcacaggaactaagagaccaaaaactcactcacctgcaacccagggagaatattaatctattcatgagggatctgccccatgagccaaataccttccattaggccccacctccaacactgggtatccaatttcaacatcagatttggagggtcaaatacctgggctacatacccttgtctctagaaaaaatatataaaatttagctgggtgtggtgacacatacctgtagtctcagctactttggaggctgaggcaggcggatcatttcggcccagaatttcgaggctacagtgagctataatcaggccactgtacaacagcctgcaagacagaatgagaccctgtctttaaaaaaataaaaataaaaataaattaattacttttaaaaagaccttgtattgcaagttggtaaacataagtacatttgttgggactatgaaattattcacccacaggatcaatgttacaaattggtatttgcatctcaatttagtttgttcaacccagaattcacatttgccataaaactgtagtcaataattcaattaaactactgataaccaaaggggaaagcaacatattgaatcaaaaatagttttatcaactggtgtcaccaaagaaaagcaggtttcactagtgttgagaaaatagaaagttttctattgattatggagaaatttcagttcagtttctagaaggttaaatgccccaattttttttttaatgactgggttaaactaaataatggcctccattatttccatatgcaaatcctcagaacctatcactgttacgttatatggcaaaagagaatttgcaaatgtgattaagtcaaggatcttgaaattgggagattatcctgggttatctgatgtccccaatgtaatcacaaggatctttataaaaaaggaaatgtgagacaaagggagagaaggtgatgtgatgaagtagaggtcagagtgatgcgggggctagatccaaggaatgtgggcagcctctagaagctgagacagacagggaaatggattctcctcctagagcctccagaaggaaagcagccttgccaacccatttgaaacttctgatctccagatctatacaacaatacatctgtgttgtttttttttatttttatttttttagggacaggtcttgctctgttgctcaggctagagtgcagtggcatggtctgggctcactacagcctcaacctcccaggctcaaatgatcctcctgcctcagcctcctgagtaggtggagctacagacatgtgccaccacacctggctaattttattttttattttttgtagagatggggtctcactatgttgcccaccctggtctccaactcctgggctcaagcaatcctcctgcctcagcctcccaaagtgctgggcttataagtgtgagagtcacagttcctggcccatctgtgttattttaatgtttaagtttgtcataatctgttacagcagcaataaaaaactaacaaaatgactaattttacttccaaacccattgtctccctcccttaaaataattttatcacaatagctatttttatattacagtcacacaccacataatgaccttttggtcaatgacaaacttcatatacagtggtagttccttaagattacagtggagctgaaaaatttttattgcccagatatgtcagagctgatcattgtacaacacattacttacatatttgtgatgatgctggtgtaaacgaacctactgtgctgccagtcctataaaagtatagtacatacaatatgtacagtacatggtacttgataatgataataaacgactgcgttatgggtttatgtacttgctatattatacttgtcttattattttagagtgtcttttttatacttaaaaaaaagttaactgcaaaacagtccttcaggaggtgttccagataaggcatagttaccataggagatggcagctccatgcatgttactgctcctgaagaccttccaatgggagaagatagggaagtgaaagacagtgatattgaagaccctggccctgtgtaggcctagtctcatgtgtaatgtgtgtttatgtctttttgttttttgttgtttttttgagactaggtctcactatgttggcccacgctggagtgcagtggctgttcacaggtgcaatcatattgcactgcagccttgaactcctggccttggacaatcctcccacctcagacttctgagtagctgggattataggcttgcaccatagcacctggctatgtcttcatttttaaacaaaaaagtttgaaagtaaaaaataaataaataaaaatttttaaatagaagaaagcttataggctgtgtgcagtggctcatacctgtaatcccagcaattagggaggctgaggcaggcagatcacttgaggctaggagtttgagaccagtctggcccacatggtgaaactctgtctctattaaaaatgcaaaaattagccaggcatggtggcacactcctgtgtcctaagctgctcgagaggctgaggcatgagaactgcttgaacttgggaggcggaggttgcagtgagccaagatcatgccactgcactccagcctggacaacatagtgagactctgtcttaaaaaaaaaaacaaaagaaaagaaaatgaaaaagaaaaaacctcactgtagcctccacctcctgggctcaagcaatccttgcacctcagcctcctaagtagctgggaccacaggcacacaccaccacacccagctaatttttttttttttttttttttttttttttggtacagacagggtttcatcatgttgcccaggctggtcttgaactcctgggctcaagagatcctcctgcctctgcctcccaaagtgctgggattacaggcatgagccactgtgcctggcctaagtgtaccactttatatcttctatagtttacttttactgtaccttttctacatttaggtacacaaatattgaccattatgttacaactgcttacagtattcagtacaataataggctgtccaggtttgcagcctaggaacaatagacaatgccatatatagcctagatgtgttgtagactataccatctctgtttgtgtaagtgcacagtatgatgtttgcacaacgatggaatcacctcatgatgaatttttcagactatatccttgttaagtaatgcatgaccttaatcaggaatgagtcacagcaatactgtaatcttgatgaagatgttgatgtagataatactcccatttacaatgcacttgccaaatacaaggcattgcactgaaagctttacagactttattttaaaaaattttacaaccttttaggtaagtaccattaaccacttttacagatcagaaaacagggtctatgaggtgaaataatttgtcatacagtggtgatgtaaatatgcatataatgaaacagaataggcaagtcagaagtgatttttgtatttcttttaatagattaagggtacttactatcagcaaaagagtgaaagtctgacagaaaagaaaaagatggaaagaaatgtggggatgtgcaattccttatgttggttggttcagcagagctttgccattgttcagatggagtttaggcaagcaaaagacgaccagccattgctgggtatttgaacatcagatgttcataaggcttaggtattcttaaaagaaaaatttattctcttaaaaattctgaaaaaaagttctctgtattaaaacttcataatgaacattgccacattgtatattaggcacagatattatttgttggagtttttggtaattgttatttttgtaactggaatatttaatatatgttttatatatatttattttatttatttattttttgagatggagtctcactctgtcgcccaggctgcagtgaagtggcacgatcttggctcactgcaacctttgcctcccaggttcaagtgattctcctgcctcagccgcccgagtagctgggactacaggcacgtgccaccacgcccagctaattttttgtatttttagtagagacggggtttcactgtgttagccaggatggcttcgatctcctgacctcgtgatccacccaccttggcctcccaaagtgttgggattacaggcgtaagccaccgctatatattttgcaaacaatagcaaatctagaggaaattctttgaagtaagaagcagtggtacttaaaactggctacttgtatttatcatctctgtttcagttttttaagaaattcaaaatttttacagagagttgataaaaacatttgatgatttggggtgcagatgaaggatggctggtatttgaaaaataaataaataaaggccttccttgattcttaatgttgagactgaaggcttcattggagtttcttcctcagcctgaattccagtgataatgtgtctgttcttgacatgagcaataactggagtacttaggattaaacaaaatattagatgtgccgggccagaggaggtgaggaaagtctaaagtgataaggtgctagtcagctcagagtggctgttttagatagtgtaatacagcagactagaaacttgtcggaaaggaaaggtaccaggcaggagataaatgtacacccaccttagctaatgtaaggagctgaaaactctattttgaatttttatcctaaacatggaaataacatccttatgagaaattgaacactaaatagacatattaaaccaattttgcttattgagacatctgttcattcatttattcaacagctatttactgagtggatacttggtagtttttaggccttagaattaacccaagacaaacttgtgaggtaggaagttgcatctcagtcatctcactactttgctctttcttgagacttcagccttccctttcctccctcaggttttggagcttagaaattaataatattaaagcttcaatgacaagactgtttaaaataaaaaatggttgggctgggcacggtggctcatgcctgtaatcccagcactttgggaggctgaggcgcacagatcacaaggtcaggagatcgagaccatcctggctaacacggtgaaactccatctctactaaaaatacaaaaaactagctgggcgtggtggcaggcacctgcagtcccagctacttgggaggctgaggcaggagaatggcatgaacccgggaggtggagcttgcagtgagctgagatggcgccactgcactccagcctgggcaacaaagcgagactccgtctcaaaaaaaaataaaataaaataaaaagtaaaataaaaaaataaaaaaaaattgttgtgttcagtgggagataatgtgttaaggaaagaaagatgttaagttctactacttgtagataggtggaattattgtgtcctttgtattgtttttgctttcctgtcataagatattccttggtttaataccataataaatacataaaaatacacataagaaactaaacaataaaaagaatgtgttaaataattttttttttttaccatttcaggttttttttctttctaattcagttaatcagtcccgctttgcttgtttgtcaaggttcttcaacttgcttaaaaactttttcaaattggtcaaaaattaatctttcaaattactacaggcttacaaaacttttatgcaccatgcaaacatcatgagatgtagtatgggaggtaaggaatatttaacctgcttcaaactttaagtattggacatttggattgttttccactttaccccgttaccgacaaagtggagcagacataactgattaatatttttaaccaaatattttgacttaagtatcgaattcctttggggtcttgaaggatataatacactatgaaagaaaagtagaaggtgctgatgatacaacgaattaggaggacctattttgtcgtgggaactttagagaagactttttgaagaagagtcacatgtcctacctcaatcagtctacaagcgcaaggaaacaacttagagttcgacaaagtcatatttatagattcattgcagtgagggagatcacacacagaactgtgaggcatctcactcaccaaacaaggacaagataatcattacaggatttgggggaagagtagagtttgggtgagatttaaatgaaaccatttaagtggcttttgatgaactcaaagcaaatcaggagtcaacatcaggtctgggcaggatccaggggtctgcttccttgaaaactagaaagttaagacagatatggattattgtgtccagaagcccttttcttaagctctgtggctggaatggaaatggaggctgattctctgtgtcaaagtgttttagagtctccaagacactatgatgttttatgttataataatataatttcaaagaacaaagtttcttagcaagtaagaaaacagtaatcactcaaagaatggggttgttatgaagctttatcgcatgtctttgggataactagtttcccgtaaactttgcagctagttttatcaatgtttattaatccagcttgatgagtgatggaacagatttttactttctaagtcctagcaaaagctttccctaaaaagagaggaccaaccaagagacaggggaaaataactttctggaaagaacaaaaaaacaagcatgaaggttgtgagctggttctggacacatttaagaccctaaaaaccaacaggacaatgacacaggcaacaaatgatttgaaatgatggagagataggggcagatctttcaggaagctgctagccttagttaggattttgcatttcatcaaagagtagagggaagtcactaaaggattctaatcaggggaattaccgaatcttcatcttctaagatagagaatgcattgtcataggcaatagtggaaggtagatgaccgtttggaaagttgttgcaagagaggatgatagtttatactagggtggcagcagtaaagaaggcagaaatggagagattcaagacaaaattttaggtagaaccaaatggtcttagtgagagtttgaatgtgtaacatgagggagatggagtcagggataatatccaggttctggcttgaatatccgagtagaaggtggcatcattaggatgtggaagactggaggtgaggcaggattgatggaaaagaacaagtacagctgtagacatcttacatttgtgcgacatttaagtaagaatgccttgaaagcatttgggtatttggatctgaggttgagaagagaggattgagttggtgctaaatatggagtcataagtatatattcaaagccatggaaaaaaaagtaacatgagaagagaaaaaggatcaggaccaagtctaaaggaactaccaaatccagaggtgaacaggaggacaggagccagcaaggaagcccaggcaccatgaagatggctgaattcacttatgaaaagcttggtttgatgctttgatgttaactcagttgtacttgtcatcaatttcttagagaatcgagagctgaaacatattctgaactgccttctatttttattcactgctttgtattatctgtagtcatctagttagacaattcctttcctgcaatgcctgtgatggaagccaggaagcatttatttctttgcgaagcatttggaaaatataaacatggccgggcgcggtggctcatgcctgtaatctcagaactttgggaggccgaggtgggcggatcacgagttcaggggatggagaccatcctggctaacacggtgaaaccccgtctctactaaaaaaatacaaaaaaattagctgggcatggtggtgggcgcctgtagtcccagctactcgggagcctgaggcaggagaatggcgtgaaccttggaggcggagtttgcagtgagccgagatcgcgccactgcactccagcctgggcgacagagcgagactctgtctcaaaaaaaaaaaaaagaaaaatataaacatgcaaatgacatcttatcacagcactgaacagatgttttaaattgtatttatttatttattcatttatttatttagacgaagtctcgctctgttgcccaggctggagtgcagtggcgcgatctcggctcaccgaaacctccacctcctaggttcaagcgattctcctgcctcagcctcccgagtagctgggactacaggcacgtgccaccatgcccggctaatttttgtatttttagtagagacagggtttcaccatattggccaccgtgttggccaggctggtcttgaactcctgaccttgtgatctgcccacctcggcctcccaaagttctggaggcgtgagccaccgcgccaggccatttttaattttattttaagcctgtgttctaaccacatcatttacctgcaggtccttggatacaatatgtacttttgagtctgagtctgtgctcacgttgttccttctgcttagaatggcctctctttccccttctctacctaatcaagtcctacttaacttttaaaacccagctctagtggcatgctcctctctgagccttttgttgttctaataaggcgtaactaatcactcctcctaaatacactcacagtatccagctcattccattagtacagatcttttcatgttttactttgctaaggtatagacaaatatatctgtctctaccattggactgtaaggttcttaagtgaccatgagttattcaactttacgtccctcatacagagaacaaatcttgttgaatttacttgcatgtaattggagatgacatggcaaagaataatgtggatatatcctgctcagcttcagataaacgctatgacatatgtaaacaaaatattcagctaacttttaaactttacatccaattttgacttatataggatgtaaactgcatacatgtacatatgcttcagacctttgaacatgctgctttctgtctggcatatgcccctatcttctctctcccacacaagtccacccatctctcaattttagtttataggctttttttttttttttttttttgagacagattcttgctctgtcgcccagactagagtgcagtggtacgatctcggctcactgcaacaaccacctcccagattcaaacgattctcgtgcctcagcctgccgaatagttgggattacaagtgtgtgccgccacgcccatctaattttttctatttttagtagagatggagtttcactgtgctggtcaggctgatcttgaactcctgggctcaggtgatccacctgcctcggcctcccaaagtaagcccggccattttttttttaagagataatatctcagtctgtgacagactggagtacaatggcgctatcaattttagttctaactaaactgtcaacaaaatctttgactaccttctctctctacctcaagatagcttgctcaattgcaatgtcaccctgcactctcattttacaacacacatcatcttttagtttctcagtaagtgttgctttctctctacaactgaaagctccaggaggcagggacaaaacctgtagtttttcttttctttttttcttttttcagcaaagggagggctgattttttaactttttgaaaatagatgaaagtaaacaataaaataataaaacctcacatgccatcgctcagcctcagtaaccatcaacccatggccaatcctgtccctactgcaaccctgcccattccctacactcacacattattttgaagtaagtcccagacaacacatgattttatttgtaaatatttcagtctgtttctgaaatgactcctttttgtaacataaccacaatgtcattattacacctaagaatgaataatatacctctttaatatcatcaactatccaggcagaattcagatttttaattatctctttcagacaatctttttaatgtcttttcttgaatcaggatacaaacaaggttcacacattgagattggctggtagtctattgtctctttttacctaccgattcaccttctattttttctttttgtttcatcacttataaatataaatactatttttttaatagctatgtctccagttcctcacccagtcttggtcatagcaggttttagataaatattgtatttgatgaataaatgaatgaatacaagtaatgcataattgagaaatctcaggagataccaaaagaaatgtaatttaataataatctttgatttctctgatctcatatttcttcaatgttctctaaatttaaaattttatttgatacataataaatgcatacttttgaggcagaaagtattattctctgaaacatttctaagaaattaatttaccctggaattgtcataattagttaattttaactacttcccctatataaaattggtgacttgggcagcaagacaaaaaaggtttctattgttaagtaagacttatttttcttcctcaagaaatcatcactagtaagcattgcaacctttactttgctattgttagatgtggcaacaactcgtgctggactcgagaaaattgtgcaagcttgaattaaataattgcttctaaatttgcttataaggaagtttattgtcttaccagggactaacactacaaatatggaaatggagtcaagcagtgattcaatgtagataacataattggaaactgggagaaagaatgttcattcaacaatcgagaaaaactaaaataaaagttaaactttacttcatcaatgctgggtccaaattaattaatgaaaacagaaataaaactatgcttcctaggataatattgacagtatttttaaaagtttattattttttaaaaagattattatatgaagagtaaaagtctttctatctctctagcctcccttattcagattttcagaggtaaaagcattgtttcttatatatccaggcattttcctatcagaatgtccaacatatgtatatttatatatagtcatgcacctcataattacatttaggtcaatggcaggccacatgtatgatagtggatggtcccataagattataattgaactgaaaatttcctatcatgtagtgacatggtagctttcataacctggtaacacagcgtattgctcacaggattatagtgatgcgatgcagacaaacctactgcactgtcagctatgtaaaagtatggcacatacaattatgtacagtacataatacttaatgataataagtgactatgttactggtttatgtatttactatactatactttttatcattattctagagtgtactccttctacttattaaaaaaaagttaactgtaaaacaaccccatgaagagtaatatattctagatacacttctgtacttgcctttcacacagttgatcatgttgttcaaattgtccagatttgggcattagtagctcctttaagttggctccgatgtcttgtagacttggcccccattattttgtgaacatgtctttactttctggcactttaaatggtctaagctcatcttgcattcctcctgctctagtctggactcagtcatttccccagggagctctggttcctttcatcgagaatggtatttagaaaccaagatctggaaactagttgtgctcattgctactgggatctcactgcatgtatatccatgagttcacactgatattcctgctctgatttcaatctggagtttgtgctacttcacaatttctctattttaactcttttatctgacagaaaactggctctcaatatccacagtgtatttcttaattactcaatcctagtatatacataaagtagtttcagaaatactaacccataccctatgaaaaacaaatttactaaagtacaatattttcatacagttctttctgtttttagccttctagtatatggttaaaataatgttctccaggttatgttagataattcttttattttttatcccatttagtataattatgtcatttatttgtaatacagttgggcttatttgttactgcttatattccattttgggtcttcccttccccaacatcctggttaattttaattatttatttttttgggggggggtgaaacattaccatatttataggaattagagctatgcatataggaatactctgagtgtgtcacatctctctaatcatttctacccatttttattccccaatttttccacgctgatcctacttaacctctgtaggtgacgaatctcatttgtttctagtttaactttccagtatgtttttcctcatatatgtggatatatgtatattttcttatatatacttctttcttacatgaagagtagtatactctagatattcttctgtactttgctttccacataagaatataccttggaaatctctgaatatgaatccatagagctcttcctcatttattttatagctgcatagtgctctcttgtgtgaattgttagagtttatttaaaaaccactgttctatatatgagtatttaatttgtttcttaaatttagcaattatatataatcttacaatgaataaacttgtacatatgtttttcatattgttggatatgtatcttcagggtagattttataagtgagattatagggctccttatgtagttatattaggtattgccaagtttccattgagaagggttgtagcagtttgtattccttaacagcaatgaaaagagtgattattttcctaagatctggctaacaaaatgtgttgtcatattttaatttattacattttattagttaaaattttattttaatttttacccatctgataggtgagaaataatagcttagcatttttttaatctgcatttttctagttatgaatttgcactttacaggtatatatatgtatttttctttttaaaaaattgtattttaagttctggggtacatgtgcaggacatgcaggtttattacgtaggtaaatgtgtgccacggtggtttgctgcacctactaacccatcacctaggtatcaagccctgcatgcattagctatttatcctgatgctctccctcttcccaacccgctgacaggcccgagtgtgtgttatttccctccctgtgtccatgtgttctcaatgttcagctcacacttatgagtgagaaacatgaggtgcttggttttctgttcctgtgttactttgctgaggatgatggcttccagcttcatctgtgtccctgcaaaggacacgatctcattcctttttatggttgcataatattccatggtgtatatgtaccacattttctttatccagtctaccattgatggacatttgggttgattccatgtccttgctcctgtgaatagtgctgcagtaaacatacacatgcatgtatctttataatagaatgatttatattccttttggtatatacacagtaatgggattgctgggtcaaatggtatttctggttctagatccttgaggaatcaccacactgtcttccacaatgcttgtactaatttacattcccaccaacagtgtaaaagcattcctttttctccacagcctcgccagcatctattgtttcttgactttgaaaagtgattatatgtatatttacggatcactttttcaacagccttgttaaggttgtggagacaaaaaccaccccatcttggatgctaatccaccatgttgacttctgattagacccagtcccatgaataacttctggtttctactttatttactgtccctagtataagatcaaaacaaccctgatgttatcacacaaattataggctaggacacacatagcattttcgcctgttctggagggttgcctttaatcgtttttgctggagcatgtgtaccctttccatacggtacccaaaccttgggtctgggaaataacagtgtggagatctacctgtcttgcagtcatccaagatcacacttctgtccataagttcctcagtaaatcacccattactgacgaactggatttgttcacttccttctttggtttctgggcttcttcagcatttgggaatagctttgtgtgcacagccttttcacagaacaaagatatgacctactttctgtttctatagagttgttaaagccatttgtgtgtctctgtgtgtgtgtgtgaattgtctattgatgcccttttcccattttttctaatgggtgcttggtgcttgatctcttaatttctaacaattatttacatattaggaatattagcccttttcctgtaatatatgttgaaagcatgtttttaacctggttgtcagttgtcttttgactttgtttatgatatttatcatgcagtttatttttatgttactagattcatcagtcttttataaatggcttttagatttagatttataaccattgccaactgctggctcctccagaaaccaccaaaatggtttactgatgaacaaaaaccaagtttattgctcactgcagtaaggaagatgactgtcttcacataatcttagtagcctcagaaaagggagtcaagggtgggatattggtaagctttggggagtctggttctaaggtatgtctttcaacatgaggtgtgcagtcctgactgggatagggtaaagtttggattgctggatacagtgaggcaagacctataaagccagccttgaaaggtaaacagtcacttgaaaacccagttgagtgatctactgttctgaaaagaaggctgtttagcccgatgaggctgtatgagtacagatacatagatcggaaagtttccaggacaaaaaagtaatttcaactttactttcttaggcaaggatttcttggaatagtaaagtcatcttagtgcagacagttcctaatctctttattttttatttttagagacatagtctctctccatccattaggttggaattcagtgttgtgatcataactcactgaaatcataagctggaatgcctgggcccaagtgatccttccaccgcagcctcccaagtagctagggctacaagcacatgccaccatgcccagctaatttttaatcttcttatatagagacagattcttgttatgttggcaagactggttttgaactcctggtctcaagtaatcttcctgccttggcctcccaaagtgctaggattacaggtatgagccaccatgcccaaccaaacagttcctaatctttttaagctgtgtggcttcaggttgcttttgttctcaacatatcctctataaatagattcctaccattggctgcgcgtggaggctcacacctgtaatcccagcattttgggaggccaaagcgggtggatcacctgaggtcaggagttcaagaccagcctggtcaacatggtgaaaccccgtctctactaaaaatacaaaaaattagccaggcatggtggcagatgcctgtaatcccagctacttgggaggctgaggcaggagaattgcttgaacccgggaagcagaggttgcagtgagccataagccaagatcccaccattgcactcaagcctgggtgacagagcgagactctgcctcaaaaaaaaaaaaaaaaaaaaaaaaatcctatcatctcttttatcttcaggtcatctttttctattttgatgtgtaaattctagttctatgttcttttagttttctgcaaaagagtacatggggatatatttataaatgcatgcatattcaaaaattttcttctgcccttacatgtaaatgataatgtgaatttcatttaggatttttgaatcatatttttgtacaatattttcataccgttctttatgttgaaggggttcctgtagcagcctgcattttcttctgcagtacttaccacaatcagaagttacgctccatcaaggcagtgagtatcaggtttatacactgctatattcccaatgcctagaaaaatgcctgacatatgataatacctcagtaaacatttgtcaataaataagtgaatgaggggcgggtgcagtggctcacacttgtaattgacactttgggaggccaaggcgggaggatcgcttcaatccaggagttcaaggccagcctggacaacatagtgagatcccatctctacaaaaaataaaataattggccatgtgtggtggtgcatgactgtggtcccagctactcaggaggctgaagtgggaggactgtttgagcccaggaggtggaggctgcagtgagccatgattgcaccactgtactccagcctgggtaacagagcaagtctctgtctcaacaactagaaaagaaaagaaaagaataaatgaatgaattagaggttgtatatgtaatgtatttcttctcctctggactataaacttaacagaaagaggaatcttctacattgtttgcctcttgtgtttcataacaaagtatctgcctcataaagatgttgcatacatttttgtaagccagtgtatgtttgcataagtgaaattcagtaaaatgcattccggtaagactcaagtagaaactaattatatattcttcttccttcctttccttttccttttccttttctttgtcttactctttctgttacccaggctggagtgcggtggcctgatcacagctcactgcagccttgaccccactaggctcaggtaatttttccacctcagctttctgagtagctgggactacaggcacacaccaccatacctggctaatttttatactttttctacaaaaatacaaggttttgccatattgcccagtctggtcttcaactcctgagctcaagtgatccacctgccttggcctccaaaagtgctaggactacagttgtgagccactgtgcccagcctaattacatattcttatttcaagacctctttgaagataaacctttagtgctaaataatcattcagtatcatatcctctcagcttctaggaccaaatatttggcttatctcaacaacatgtattcagaatgcccaattcaatcttgtctttgcagaaaaaatcattttctcttatacacgatcccaaaatatgcaagaaaatatacatatttttctcttctcccccttgtttcataaactggtgttgagtttttaatttttattgatggtttggaatttataatgaaaatgaaaatgctgatgaggtctttggctgtagtaacaagaagtactacagatgactcagagaataaagctgcctcacattacattaaaactcatctcttggaaaatggtgtaaatggttgactggagatgaaggtaatttatcaatttatgtggttgaggcatattacatgatcttaactttcataaaattaaatctgaatatataacaatttgaaataccttaatgctaagccttatcatttggcgaagccccttttatcaaattgaaactctaaaattacctaccatcatttatcccaatggtataacatgtcaatggcttacaatgtatcatttattttcataatccatccttcatgaaaaatattacctaaagtgtttaccataaaagtgagtgacacctaaggcaaagaaaaataacaaaaatagaattaaagagaaaggactcagaggatggaagacattgatttaggaagaatgaatgacggagttataggagcatcctataatgttaagttgttacatcttgctaaaggccaagctcattctgcatatgtgaagagttgattgcattatttacatagatgtatcttgggatttgaacaaagttgtaagtcagtatagaggaagttgggcattccagggtgagcctattagcgtcctccagagtagaaatattggaatggtctcatacagaagagatagaatataggataattcgtcattgattacttcctctgaattaggatatatttataatactgtttttaaaccagataaaactagagaaaatctcaagtaattagtcaatttattgtattccccatctttcttctctgaaacattccctaggtatacagtagtgtaaatatacatttcaaaagagagaggtgctacagaccctctttgcaacctgtatgtgtatccaatcctcttgtcttcttcttcattctgtttcaagaggattacacttttaaaatgtcttttgaattcctgatcgccttaccattccatttccactgccttgtcacctttcacaaagagtactgaggtagcttctttaaaaaatatgtatagtttcaacttttattttagaatcagtgggtacatgtgcaggtttattacatgggtatgtttcatgaagttgagtccgttacccaggtagtgagaaaaatacacaatagttggtttttcaacccttgtccccttcttctctcctccctctagtatttgccaggatctatttttcccatctttatgtccatgtgtacccaatgtttagctcccacttataagtgagaacatgcagtatttgattttccatttctgtgttaattcacttaggataatggcctccagttgcatccatgttgccacaaaggacataatgtcattcttttttatggctacatagtattccatggcgtatatgtaccacattttctttatccaatccaccattgatggacacctaggttgattccacgtttttgctattgtgaatagtgctgtgattagcatacaagtgcatgtctcttttgtgtaaaattatttattgtcctttgggtatatacccagtcatgagattgctgggtcaaatggtagttctattttaaattctttgagaaatctccaaattgctttccacagtggctgaactagtttacattcctacaaacagtatataagtattcccttttctctgcagccttgccaacatctgttattttttgactttgtaataatagccattctgattggtgtgagatggcatcttattgtggttttgatttgcatttctttgatgttgatataatcaccaaaaacgtaaacatttcagttgctattggttacatgttacgttttctgttgtttttattgttgtgtagttcctcctgagctggttcggctctgtgtccccacccaagtctctcaccttgaattgtaataatccccttgtgttcttggaggaaccccgtgggaggtaattgaatcatggggagggggtttcttcccatgctgttctcatgatagtgagtaagtctcatgagatctgatggttttaaaaaggggagttctcctacacatgccctcttgcctgctgccatgtaagatgtggtttttgccttacaccatgactgcgaggcctccccagccatgtggaactgtgaatcaattaaacctcttttctttacacattacccactctcgggtatgtcttcattagcaacatgggaacagattaatacagtaaattggtactgggtagtggagtgctgctgtaaagacatcagaaaatgtggaagctactttggaactgggtaacaggcagaggttggaacagcttcgaggactcagaagaagacagaaaagtatgggaaagtttggaacttgctagaggcttgttgatggctttgaccaaaatgctgaagtgatatggacaataaagtacaggctgaggtggtctcagatggagatgaggggtttgttaggaattgaagcaaaggtgactcttgttatgctttagcaaggagactggtggcattttgcccctgccctagagatttgtggaactttgaacttgagagagatgatttagggcatctggtggaagaaagttctaagcagcaaagcattcaagaggtgacctgggtgctgttaaaagcattcagttttatttattcacaaagatatggcttggaattgtaagttatgtttaaaaggaaagcagggcataaaagtttggaaaatttgcagcttgatgatgtgatagaaaagaaaaactcattttctgaggagaaattcaagccagctgcagaaatgtgcaagtaacaaggagccaaatgttaatacccaagacaatggggaaaagtctctagggcatgtcagagaccttcctggaagcctctcccatcacaggactggagacctaggaggaaaaaatggtttcctgggccaggtccagggctccattgctgtgaggaacctagggacttggtgacctacatcctagctgctccagccatggctaaaaggggccaaggtagagctcgggttgtggtttcagagggtgcagcttggcagcttccacatggtgttgagcctgtgggtgcacagaagtcaagaaccaaggtttggaaacttctgtctcaatttcattggatgtatggaaatgcctgaatgtccaagaagaagtttgctgtaggggcagggccttcatggagaacctctgctatggcagtgcagaaggggaatgtggagttggagcctgcacactgagtccccaatggggtgctgcctagtggagctgtgagaagaggggcactgttctccagaccccagaatggtagatacactaacagcttgtgctgtacacctagaaaagacactcaatgccagcccatgaaagcagccaggagaggggctgtaccctgcaaagccaaaggggtggagctgcccaaggctatgggcgcccagttcttgcatcaggatgtgagacatggagtcaaagaagatcatttcagagtgttaagatttggctgccccgctggattttggacttgcataggccctgtaacctctttgttttggccaatttctcccatgtggaatgggtatatttatgcaatgcctatacccccattatatctaggatgtaactaatttgcttttgattttacagactcataagtggaagggacttgccttgtttcagatgaaattttgggcttggacttttgggttgatgctgaaatgagttcagttttttgaggattgttgaaagcgcatgattgtgtttttgaaatgtgaggacatgagatttgagaggggccaggggtggaatgattgtagggaaaagaaagagagatcagactgttcctgtgtctatgtagaaaaggaagacataagaaactcattttgatctgtaccctgaacaattgttttgccttgagatgctgttaatctgtaactttagccccaagcctgtgctcacagaaacatgtgttgtatggaatcaaggtgtaagggatctagggctgtgcagaatgtgccttgttaacaatatgtttacaggcagtatgctggtaaaagtcattgccattctccattctcgattaaccaggggcacaatgcactgcggaaagcctcaggggcctctgcccaagaaagcctgggtattgtccaaggtttcccccaactgaggcagcctgagatacggcctcgtgggaagggaaagacctgactgtcccccagcctgacacccataaagggtctgtgctgaggaagattagtaaaagaagaaggcctcttgtggttgagataagaggaaggcctctgtctcctgcatgcccctgggaatggaatgtctcagtgtaaaacccaatcatacattcattctattctgagataggagaaaactgccctgtggctggagatgaaatatgctggcggcaatgctgctctgttactctttactacaccgagatgtttgggtggagagaagcataaatctggcctacatgcacatccaggcatagtaccttcccttgaacttatttgtgacacagtttcctttgctcacaggttttcctgctgaccttctccccactatcaccccgttctcctgccacattctccttgctgtgataatgaaaatagtaatcaataaatactaaaggaactcagagaccggtgccgatgcaggtcctctgtatgtggagcgctggtctccttggcccactgttcttttgctatactttgtctctgtgttttatttattttctcagtctccccatcccacctgacgagaaatacccacagctgtggaggggctggcccccttcagatgatatggtttggctctgtatgcccacccaagtctcaccttgaattataataatccccacgtgggatcaattgtgggaccaggtggaggtaattgaatcatgagggtgtcttctttccatgctgttcttatgatagtgaataagtcttacaagttctgatggttttataaaggggagttcccctacacaggacctcttgcctgccaccatgtaagacgtgcctttagccttccaccatgattgtgaggcctccccagccatgtgcaactgtgagtcaattaaacctctttcctttatacattacctagtatcgggtatgtcttcattagcagtgtaagaacagactaatatgctgcttctacagtttattgaatttaacttttaaatcaagttgtgattttattgttgttgttgtctttgagtcttgccatccaaatcaaaactgggctaatttgtggaaataatatctattgggttaaggagagaattgttagatgcagcctaaaagaaagaatttagtgttcactgtatctatcatgaaaggctctttctatttgttttctattataaagtaatatgctgtatttcatggcaaaggctttaaattgaaaactccaaggcttaaaatttaagccttgcatttggaaatagacaactagctctacagaagtagttttgttttgtttttgtttgtgtttttttgcagtggggggctggtatttgggggcagggagaggggaaaaagtccatttgctggtactgagtgactttgggcaagttacttgccctctgtaagcctcaatttcctcatctataaaatgggatattagctttcttgtaggattgttgggagaattaaatgagataaggaatatctgtaaagcagttaacatgaaacaggccctcaataaatggaaactaattttattgtttgtaatagaaaacaacaatgtgtcagcttctagtaataactttaaaatattctatgcatactatatagcaaaggcagttttacttctaatcacagaacatataacactaagtatagttctaatacttaagaagcaaaataacaccagggcagtaacaaatgctggagaggaggtagagaaaaggaaaccctcatatgttgttgatgagaatgtaaattagtacaaccactatggagaagagtttggaggtttctcataaaagtaaaaatagagttaccatatgacctaacaatctactgggtatatactcaaaagaaaggaaatcagtatatagaaaatatatttgcactcccatgtttgttgcagcactattcacaacagccaaaatttggaagcaacctaagtgtccattcacagatgaatggataaagaaaatgtggcacttatctgcaatggattactattcagccataaaaaagaatgagatcttgtcatttgcaataacatggatggaaccggaggtcattatgttaaatgaaataagccaggcacagaaagacaaacatcacatgttctcacttatttttggatctagaaatcaaaacaattgaaaacatgaaaatagagagtagaaggatggctaccagaggctgggtagtgtaataggggtggggtgggtagggaggtgaggatggttaatgggtacaaaaaaaatagttggaaagaatgaatacagccgagtatttgatagcacaacagggtgactatagtcaataataatttaattgtactttctaaaataactaagagtataatgggactctttgtgacacaaagaataaatgcttgaggtgatgaatactccattctccgtaatgtgattattacatattgaatacctgtatcaaaatattacatgtaccccataaatatatacacctataatataccctcaaaaattaattttttttttttgagatggagtcttgctgtcacccaggctggagtgcagtggtgcgatcgcaactcactgtaacctccgcctcccaagttcaagagattctcctgcctcagccttctgagtagctgagattacaggcacgtgccaccacacccagctaatttttgtatttttagtagacatggggtttcattatgttagtcaggctggtcttgaactcctgacctcgtgatccgcccacctcggcctcccaaagtgctgggattacaggcatgagccactgtacccggccaaaaatcttaaaaaataccaggggacatatcagcatagctgagccactctgactttttatcagtttccggaagacacccatctccttcttacctctaggcctgtgtatttccattcccttcagcctggaaagctcttatccaagctatttacatggctggcttcttattctttagttgttagcttaatgtcaactccttacagacaccctacctgattatcttagctcaattaggccgttccttgctctagtcactattatagcatcctatatatttccttcagagaggttgtcacaacctgaattaccttatttttttgttcttgtttacttgcttactatcagtctctcccattaagctccaatgacatggtcaaggaccacatctacttgtggcccattgaagaccccttgcctaacacagtgtctggtacatgttgaattgtcagtaaatatttgttgaaacaattggttaataaatactgttcctgaaagcctctctgccactgtctctgcagtagaactgcccttgctaccctcagactaatgaagaagagaagaccctaagtaccttatttatacctccaacaagctgcaatcaacccaagaagaggaggccagtccgtctcccatggttcccacacccccaacccccactcatcaccagagagaacccctggcttgagcccacagcacagacccttcatcctggggtgattgcactgaggaattgctgacctacatctctctggtgtggagctcccaggatacaagcaaaagacccctgaccacaaccactactaaggtcctttcctctgttgccgccaagttgaggaaggaacgtaaacactgacattgccccagagctgcagtgggcagccaggagtgtcaaaccacaatctacagccatacagctggcactcaagggggcgaggaacccacactttcagagcatcgagagtgaacacagctgtaactatgagaaaacatagaggagccacacaactgagcaagagtctaccagttgaccaataagcctaagtgccacctactggatcacaccccaaagcttcaacaccaagaatacctcactaacatactcacctctgaaactagagacaagaagtcagcttcaaaaaaagaccctgcacaaggcctcagcctagtgaaaacagccagaagtctattgactgtactcaatctatatggcagttaaaggaacacccacacatggagatgagaaagaactaacgcaagaactccaaaaattaaaatggccagagtgtcatatgtgctccaaatgaccatacaaattctctaacaagagtgcttatccaggctgagctggctgaaatgacagaaatagaatttaggatatgtataggaatgaagatcattgagattcaggaggacagcaaaacccaatccaaagaaaccacaaatcacaataaagtgatacaggagctgaaagacaaaatagccagtataataaagaacctaatgggtccgacatagctgaataacacagtacaagaatttcacaatgcaatcacaagtattaacagtagaataaaccaagctgaggaaagaatctcagaactcgaaagctggctttctgaaataagacagtcagacaaaaataaagaaaaaagaataaaaaggaatgaacaaaacctccaagaagtaggggattatgtaaagaagccaaatctacaaatcactggcatccctgaaaggaagggggagaaagcaaacagtttggaaaacatatttcaatatattgtccatgaaaacttccacaaccttgctagagaggacaacagtcaaatacaggaaatacagacaactcctgcaagattctacacaggaagatcatccccaagacacataattgtcagattttccaaggtgaaaatgaaagaaagaatgttaaaggcagccagaaagaaaaggcaggttacctgcaaaggaaatcccatcaggctaacagtggacctctcagctgaaaccctataagccaaaagagattgggggcctatattcaacattcttacagaaaacaatcttcaaccaataattttatatgcagccaaactaagcttcccaagcaaaggaaaaataagattcttttcagataagcaaatgttgaaggaattctttactaccagacctgccttacaagagatctcaaaagaagcactaaatatagaaagaaaagatcactacgagctaatacaaaaacacacttaaacacacagaatagtgtcactgtaaagcaaccacacaaacaaaccaacataataatcagctaacaacacaatgacaggatcaaatccacacctaacaatggtaactttgaatgtaaatgggctaaatgctcaacttaaaaggcacagaatgacaagatggataaaaaagcaagtcccaatggtatgctgtctttaagagacccatctcacacataatgacaccaaaaggctcaaaataaaggcatggaggaaaatctaccaagcaaatggaaaacagaaaaaagctgaggttgcaatcttaatttcagacaaaacaaacttcaaaacaacaaagatcaaaaaagacaaagaagggcattacataatggtaaagggtacgattcaacaacaagatccaactatcctaaatgtatatgcaccgaacacaggggcacccagattcatgaagcaagttcttagagacctacaaacaggcatagactcccacacattaatagtgggagacttcaacactccactgacaatattagacacataattgaggcagaaaattaacaaagatactcaggacctgaactcaacattggaccaaatggatctgatagacctcttcagagctctctactcaaaaacagcagaatatacattcttcccatcgccacatggcatctactcgaaaggcaactacttaattggacgtaaaacaatcctcagcaaatgtaaaataactgaaataatacgaaacacactctctgaccgcagcgcaataaaaatagaagtcaaagaccaagaaaatcttcaaaatcaggcaatgacatgaaaactaaacacgctccagaatggcttttgggtaaataatgaagttaaggcagaaatcaagaagttctttgaatctaatgagaacaaaaatataacataccagaatctctaggacatagctaaggcagtgttaaaagggaaattcatcgcatgaaatgcccacatcaaaaagttagaaagatctcaaattaacaacttaacgtaacagatgaaggaattagagaggcaagaacaaatcaaccacaaagctagcagaaaacaagaaataaccaaaatcagagctgaaatgaaggaatctgagacacgagaaaccattcaaaagatcaacaaatccaggagttggttcttttaaaaaattaataagatagataggctactagctagactaataaagaagaaaagagagaagatccaaataaacacaactggaaatgacgaagggaatgttaccactgaccccacagaaataaaaataaccactagaaaccactatgcactcaaactagaaaacctagaagagatggataaattcctggacacatacaccctcccaagactgaaccaggaagaaactgatcccctgaatagaccaataatgatctccaaaagtaagtcagtaataaatagcctaccaaccaaaataaagctcaggacctcatggattcacagctgaattttactatatgtacaaagaagagctggtaccatttctataaaaactattccaaaaaactggggaggaaggactcctccccagctcattctacgaagccaccatcattctgatacaaaaacttggcagagacacaacaaaaaagaaaacatcaggccaatatccttgatgaacatcaatgcaaaaatcctcagcaaaataatttcaaactgaatccagcagcacatcaaaaagctaatccaccatgatcaaatagacttcattcctgggatgcaaggttggttcaacatacgcaaatcaataaatgtgattcatcacataaacagaactaaagacagaaaccacataattatctcaatagatgccgaaaacgctttagataaaattcaacaccccttcatgttaaaaactctcaataaactaggtattgaaggaacatacctcaaaataataagagccatgtttgacaaacccacagtcaacatcatactgaatgggaaaagctggaagcattccccttgaaaactggcacaagacaaggatgccttctctcaccactcctattcaacatagtattggaagtcctagacagaacagtcaggcaagaaatagaaataaagggcatccaaataggaagaaaggaagtcaaactatctctctttgcagatgacattattctatatctagaaaacctcttttttttttttttttttgagacagagtctcactcttgttgcccatgttggagtgcagtggcatgatctcggctcaccacaacctccgcctcctgggttcaagtgattctcctgcctcagcctcccagagcagctgggattagtgatatacaccaccacacctggctaattttgcatttttcaatagagacagggtttctccatgttggtcaggctagtcttgaattcctgacctcaggtgatccacccacctcaacctcccaaagtgctgggattacaggcatgagccacaacacttggcctatatctaaaaaaccttatagtcttggcccaaaatttccttcagctgataaacaacttcagcaaagtttcaacatacaaaatcaacgtacaaaaaacactagtattcctatacaccaacaacagccaagacaagagttaaatcagaaaggcaatcccattgacagaaagaatcaaatatctaggaatatagctaactagggaggtgaaagacctctacaatgagaattacaaagcactgctcaaaaatatcagagaagacacaaacaaatggaaaaacattccatgctcatggataggaaaaatcagtattattaaaattgccatactgcccaaagaacttacagattcaatgctattcctactaaagtgccaacaacctttttcatggaactagaaaaatctattttaaaatttatatagaaccaaaaagagctcaaatagtcaaggcaatcctaagcaaaaataacaaagctggaggcatcatgttacctgacttcaaactatactacagggctacagtaaccaaaacagcatggtaatggtacaaaaccaggcacatagaccaatagaacagaatagagagcccagaaataaggccacacacctacaataatctgatcttcaacaaagctggcaaaaacaagcaatggggaaaagactccctgttcaataaatggtgctggggtgactaagcagccacatgcaaaagattgaagctggaccccttctttataccatttacaaaaataaactcaagatggactaaagacttaaatgtaaaacccaaaactataaaaactctggaagacaacctaggcaataccatcttggacacagaaacagacaaagatttcatgacaaagacaccaaaagcaattgcaagaaaagcaaaaattgacaagagggatctaattactcttaagagcttctgcatagcaaaagaaattatcaacagagtaaagagacaacctacagaatgggagacaattttcaaactgtgcatctgacaaaggtctaatatccagcatctataagaaacttaaacaatattacaagagaaaaacaaccccatagaaagtgggcaaaggaccccttagaaagtgggcaaagaacataaacagacacttttcaaaagaaggcatacatgtggccaagaagcacatgaacaaaagctcaatattactgatcattagagaaatgcaaatcaaaaccactatgaagataccgtctcacaccagtcagaatggctattactaaacagtcaaaaaaaaaaaaaaaaaaaaagaaaaccagatgctggtggtgaggttacagagaaatgagaacatttatatgctgttggtaggagtgcaaattagttcaaccattgtggaaagcagtgtggtgattcctcaaagagctaaaagcagaactaccatttgacccagcaatcccattactgggtatataccctgaagaatataaatcattctaccataaagacacgtgcatgcaaatgttcatcttggcttggtttctcattcttttgttcacttttcggagtcattttcctaccattcatttgtgcatgcagtgtctgaatttcagataacaaactcctatgtgctttctggaggcattccatagctgcttgatattcaacagcactattcacagtagcaaagacatagaatcaacctaaatgcccatcaacaacaaattggataaagaaaattgggtacatttataccatggaataccgtgcagccacaaaaaagaatgagttcatgtatttcgtgggaacacggatggtgctggaggctattatcgttagcaaactaacacagaaacagaaaaccaaataccacatgttctcacttataagtggaagctaaatgatgagaacttacaaatgtgaagaaggagacaacagacactggggtctacttgagggtggagggtgggaggagggagaggagaagaaaagatagctattgggtactgggcttaatacctgggtgatgaagtaatctgtacaacaaacccccatgacatgagtttacctatgtaacaaaccttcacatgtacccccaaacctaaaataacagttttttaaaaataatcaatattgtcccagtcctccattttacagatatggaagttgtgattaaaatgtgattaatgtcacagaaatactaggaaagccaagcttctaacagtcattccagggtcattgccagggtgtcaaatcctatgtcactgcacagtattactataacaacaaagtgtccctttcctgacttcctattccccattcttgatccagcatctttgggatccacttccaggcattttctctggggtcctgctggcttaagtcagccagatcctgcagtgcctttgccatatgatcctcccctcccttaacagacactgtacttacccagttggattatactgaaacttagtcctcatactgtctggtatcggggagagaagtgggggtagattctgagcaggaccaacattgttttgtaagacacttgacttactcgaagcttatagttttcaagcaaggagaaggtcttccatcttccagcaagggagtgggccacctctgtaggcccagatattccggagaagctgggaggccaaggtccttaagtgtgtctaataagtttccccattccaattctcatgttcccacttttttccaatcaggaccctgattctcttgaaggagacttacacaggctgagaattaaccttctctggcgttctgccactcataagtacaggctgcacctgggcttcagttcagttggccttctggctgccagtgatgagggactttttaaaggcttccatggaggccctttgactctcacacttgggtttaaattggtggttaatagatttgatcctggcatctatacttagtgcatcaatggtgcttaccaataccctcccaattcaacaatctttcaagttacttttccacctgtactctcaaatactagatacatcacagaagttaatgcattcgcttctacttatatgctgtcctggttcactacaagtaaaagtgttagcaatttcactgcaggagcacatctgagactatcttcagggaagagattctgatgggaccactggtgagtgagcaaactccagaatcccatccttagactcaggtgtatataactactactgctatcaactgtcttagattgggctcttgcagctgaccctgagaattagattcctgtccaagtgattgcctgagggagtgctctcagaagaaatctgaacagcgaggaaggaagcagaataggacaggaaaagaagctgggaaagatatgggtttagctgaagtctagcctcagtctgatcccacagggagttctggagcctcagttctgtacacccgtatcaatcagtcattggctgtgagctacccacgggggaaggctgttaccttccaggcattttctgaaattgttggcttgaatggaatcctcagggaaagagtgtgaactattagcagccaacactctcagcagctaagggatgagtacgccagctcattgaagagattctggacaggacaccaacagcatcttcagtaaagatgtacttcaatggtaaggacactgaacccagaaagaaggagtcacatgcaagaagaaatggtggaccaagaaatgtataaacatctggctatatctgaataagcactcttatacacaacaataatggggaacaatggctaatttggagatggagggtatttaaaaggcagaatttaaacaataaacattaataaggaatatggggtaattagtattgaaagtttctaaagcccttgtatttctgaggtgaagggtaaatacattaattaaatttagattttattatgtcaagttatacttgtaaaaatttaatggagctcccagatgtagggagtaaattaaacacatgcatcaaatttggtcctccccaaatccagttaatttgtcagtgaatttttttaagtcctgggccatgggaaaataaacaataataacacaattttggaaaattggatgagtgagaaaagacttagcagaactcccaaattaaagtactaaaccagcagcaggaaagccaagaagcaacttgttttacactcaagagccttcaagtgtcaggaattggcagcatcagattcttctggaagtgtggtgaagaggagagactaaaatgagaatgatgcgctgaaagtttatttaagaagcagtcagatcactagatcctttccaatcatgaaaaggtacactaccgcttctatttcccttctctttcccaggaagcatattcacaggagagagagaacaggtttcctgcttggggatcccaagcagagttgaagttgggagcactgtactgaacaaagccagcttaagaaaatgcatgcatactgaatgcccacctctctctactccactatctcgcttgacccagatccaaaatagtagtagcagactttgactcttctgacaggagattggaagaatcttacctgatcagtccaggaggaaaacctaaatgcagtaacatcagggttccctaactaagctgtccagaacttaccatcttcaccaaaacaagaaattaaaccaataaagtggaagatcagggcaacacacccaggacatacacccaggttgggagacacatgtaggagagtaagacagtgaggccagaatgatgctgagggaaagtcccaagatgacagctttatgtcttacgcatcaggcataaagaccaataggccatcagaagaatgaagcatattttgtcaggaagatgaaagcaatgcatcttagtagcttaagagaagatttagagaactggcaaataatttgggattaaattagtgataagtacatagaaaactaagcaaatggtaaaacaagataattagctccagggcaagcaaaaagctgctcaggaaagaaaaatttatcatagtttcctacatggctcagctgtgaacagtttgtgcatagttatattaatgtaaatatattgcttgatatcaaacgcaaacataatatgactgtattgtgagggcgtgaagaggaaagaaggcacatatatggtgggagcagtcattttctagagtgggaagtcagtagataataccaaaaactggaaaattgagaaatataagaaattgagaaatgaatgttttttagagacatggaagtagataccaacatgaccagtaaaagaaatgtaaatgattgtttcaggggaaggaaggagggatataaggctcatgaggaagtatctgatattttcaactatgagtttttaaaatttttggtgaaataaaatctaaatataaaaacaaagatggaatgggaatataatgaaatattcaactaaaaatatttcaatggcaactactgaaagaatgcaaagaaaatatataatttccaaaccagtatgaggagaaaaaagaaaaagagaaaaaaataaaacacttcagtaatcccttagaaaacaggaaagaagaatggaagaagcaaagcagaagcttggtaataaagaaaagaaaaaaaaagtaaaagaggctgagcacagtggctcatgcctgtaatccaacactttgggaggctgaggtgggcagatcacttgagcctaggagttcaagaccagcctggacaagatggtgaaaccccgtctctacaacaaatacaaaaattagccaggtgtggcagctcgcgtctgtagtcccagctacttgggaggctggggtgggaggattgcttgagcctaggaagtaaaggctgcagtgagctgagattgtgccactgcacttcagcctgggcaacagagcaagaccctgtctcaaagaaaggaaggatggaaggaaggaaggaagggaggaagggagggaggaaggaagaaaaaggaagggaagagggacggaaggacagaagagagagagagagagagagagtgagattcaactaaggtaaccaggcaagctttggaagagaagtgtaagaagaagaaagggattttaaagaatgtgtggataagtgtgacagtcttcagccaaacaaactgattcccagcagtcaaagacaagtactcaagcactgcagggccatgaggaccttgagaaaaaggaaaggtggtaaggaaatcactcagagtgggccctgggtgctggccaataggtggtgctgtctgtatggacagcagtgttgtcatccagggcagcaacacagtggaaaggaaatccaaagcttaatgagccattcacatataagaacctttgccagctaagtgttcataatttgagaattacatatatttcagtattcattatatgactcaagatttcaatatttcaatattcaatctacacaactgatatggtttggctctgtgtccccacccaaatctcatttcaaattgtaatccccacatgttagaggaaaggcatggggggaggtgactggatcatggcggtggatttctctcttgctgttctcatgatagtgagtaagttctcaaaagatctgatagttttaaggtgtggcaattccccccttgctcttttactctctcttgccaccatgtaagatgtgtcttgcttctccttcaccttctgccatgattgtaagtttccccagccctgcagaactgtgagtcaattaaacctctttttctttataaattacccattctcaagtagttctttatagcactgtgaagatacaataaccaacacttatacaatacaataaccaacacttaactagtattaatgatatacccctattaagcaaaaggatttcttgagtgaagtaaacccaataaccagtatttcttttcaaaaacatctataaaaatactaggtttctataaaattttccagataccacttgatagtcattcaattgaacattgaatatgctttgtctcaatttccaacattcaagataaatattttttctattttattacctttttcattttatcattaaaattattatatcatattttttcatttttaaagagagagtatttcagtaactttataaattaagtaagtttttgctggccaatttggaaaactaaacaactattttaaaagaggaaaacgcacaccggaatcaacaagtaaaaattgaatgtcatttttattactatttttacttataagaattatagaaatatttggttatttcaattccctatgtgtataactcatcacaatttgataaggagataggtttaagtgtatgtgtatataaaaagagactgaaaggaaaaagataagtagttatctctgattggttgttgggattagctatattttccaaatactctagaatgaatatgtattacttttctattattaattgggttagggattaaaaaaacattagacctgtatgttaaagttgaaccagcatcgtcaggaaggatacaaaaatcacctgccaaacgatgtccatttcaatttactttatgtcctttctaggaccactgtgagcagttgtaggtacctgtgagagtgctcaatgtaaaaaaaaatttctgttaccctaaattgggttaatgataagtgtctaaaggagatgtagatctagcatataagaccttctagataaatttaaagatatcaggaatgaaggctgcagaggagtactttggaaaaaaagtttagtaatgaaaagcaatatgaattgtttcagaaatactgtgacttggagacatgggaagtgtatcaaacagaagtcgaggacagacataaatgaagtgacttgctttcaatacgacagatgtccaagacggaaaaatgtcacccagggcaagaaaatgactcaggctggaataaagaaactagctgcagagagaataatttaatcaggaaatcgaagccaggtacagtcgctcacgcctgtaatcccagtgactccagagcctgaggcaggaggattgcttgaacccaggagtttgaggctgcagtgagctatgattgcaccactgcactccagcctgggcaacagagtaagacctcatctctaccaaaaacaaacaaacaaacaaacaaacaaaacccatagggaaccaagtggaagacttaggatctattgtcttcttttatctcaagctggtggaaatagctctgcatttaaaggtagaaataaggatggagcagatagacaacccaaaactaagagtcataactataaaatacctaaatacatattaattttcaccaagctaaagtgaaaaatgaaatgttcaatactatctatgctgtatttgtacgtatgggatatggtgtgtggtggatactgggctgggcccttgaaactatgaggctaataacactgagaagggaagatgggagaaaaagcagtatgggaggtcttaaagtcttggtaacttcagaaatgtgctaggatttgtgggcagcagatatttcaaaacactaagtaaagaacgctggagttaaaggcatggagcttcagaaagttattagcactgatagccaaccacggtggtgggtgcctgtagtctcagttacttgggaggctggggtgggaggattgcttgagcccaggagttcaaggctgcagtgagctatgatcatatcactgcactccagcctgggtgacggagaccccatctttaaaacaaaacaaaacaaaacaaagataagaagaaaagaaagttactggcactgagagccagacagatgcccaaagtaagagcccattaagaatttccaccatgagataactggaacagtaattttcacattaaaaatagctttcttcctgcacttaaagggatggttcgaggaagcagattctaaaggagaggtgaaaaagaagacatgctctggatgtttggagatacagctataagccaacatcctcggcaagccctgtaccaccccaatgccaccactccctgttccagtgggtagacatgggtgggagcagcatgagtgattacagttagggggctaatatcaccgtctttatttcatcatgtctccaacattctgagaaggacatagtggtcactatccctcaaccaaagaaactgatgagtgcagtaggaacctgctttggagggttcacattgggactcatcaatgtggaaggtaaaaatctgaagatacaattgaaatctagatagccttgaatggtatggacaaggagacataaaatctgcttactaaatcagaataataagatgaaaggtcaataataagcatagaaaggtcaataatggaataataatagtagaggtcatccctagaaggttgaaaacattttcaagtaaatataagaaactccttattgtacgtagtagtgcaggctggaaaaatatacttatttagttcaaatcatgtgacaggcactaggaataaagttagtccctgccctcacagggttcaaggtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgttgccattgatttccttattaacaggttttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggaacaaagctattactccaactgtaaggtttcattataagcacgtaaatatagttcaaagttaccacatctgtaaactcaaaaatgctgctcacttggctggatccaatcaatatttgctaaccattattttagttattcttcatatagacaggcgctttgtttcttagaagaaatcactgtccataaccaaaaaaaaacttaattgtgaaatggttttatttaaaacagtcttttctggttattgaacatttcatatgaataaattaatcttcatgcatatgatagcttatctgaaatagcttcccaattctttaaaataccaaaggcttcttttctcagaataaggcattttgccatcacgtggtttattagcagaataggaaaattaatcttattctaagcaaaagcagaaatataattagccaaaccaagaaaagtgtgacatttgcccatgaactcttcattcagataatatatctattttgggaactcatgagacagaagcaagacaaaaatatgagaagatattaggtttctctaactattgttcaaaattagaaaatggatgtggcttttatgttgactctttcaatacctatatgaagacagttaaaggatgtatgaaattaaaaagcgacatcagtgattattagtaactacttcacaggaagcaaatgggagtatcattgtagttagtggtatgtgaacgactgattgtactggtttatcttcatgctctcgcctcttctctttaactctacgcagtacatagtatgggattatctttaccacatgcccctagagattctgtttcacttcactcagaacctagaaaccacttgctccaaaacttgaaaaatattaagagctgatgtccccagactgctcctcaaccttgaactcaaaccactaagctccaggataaattcgtttaaaatgattgtgcttaaattttcatgtgggtctaaatttgctgggagagaaagtcctttgtttgtattttcgcatattgagaatatttatcatgattattacactgaagagcctaactattcatttaccccatttttaagatgtagtaaagacattttcctctgtggaggaagctattgtgcaagattttatcacgtgttggcggaaaatttgagtgtctgaattttgtttcacacatgtgttcagctttgcatgtgtatttctgtgtgtatatagaacatagaaaagagtctagattagaagataatgtactgaccacgttcaaagtgattatttcatcacgcaggtaataagcatagtactccataggaagttttttgattctctccctcctcccagcctccaccctcaagtaggccatggtgtctctttttccgctttttgtgttcatgtgttctcatggtgtatctcccacttataagtgagagcatgcagtatctggttttctgtttcttcattagtttgcttaggataatggcctctagctccatccatattgctgcaaaggacatgatctttttcttttttatggctgcttagtattctgtggtgaatatgtaccatattttctttattcagtctactactgatgggcatataggttgattccatgtctttgctattgtgaatagtgctgcaatgaacatacatgtgcatgtgtttttatggcaggatgatttacattccactgggtatatgcccaataatgggattgctgggttgaacggtaattctattttaagtttttcaaggaattgctacactacttttcacaatggctgaactaatttacattcccaccagcagtgtataagtgttacaaaagattatttatgaagacagagattatatgggagtattcttttctttagtatgttcctctttattttctagattttttgcagtgagcataccttacttcatgatgaggaaaaaaaattgttattcctccaaaatgattgagcactttgtatgtacacaatactgcaataagtgattacgggaattaaaaaaaaccttttttcttttttggagctttcaatattcacaaataagttgacgctatgtgataatatttgtattgcctgttatgtatcagatacttctcccatttaatttcacatactctatctcctttaatccaaatatagagaatacgtgtcaatccactccatgttattgtaaataatgttgacaatgcacagagacgcatattttataatagtaagttacaaacacaaggtaaaaataggcagacagaaagctatgcataaagactaaatggaaagcagtctagatagtgataatttttttctacctactaaatttactagtaggagcatgtatccttcccataatgagagaaaaaatgaacttttaatgatttttaacatatatgacagccatggaacaattctgtgctaactttggggtacttatgtgcagcatattggacatttagtgaaaagagagaccactgtgagatgatgaagctggagaaggcttcaagaagcaatgcagggctccctgagtactttaaaggaagggcaagtttctttaagaatgtggaaggaggacaaggaggacgttatagaaagaaaataacttgtacaatagcaacaagaactggtccatttataaaacaggagcttgctcaggtggtggctatgaggattaagtaagttggtgcacctggcatcatgcctggatgaaaggtgctcaggaaatattagccatcatgatgatggtgctggtgagaatggagaagagggatgaattcaagacacagtccaaaggactaaatggtaaacttgttcacagtctggttccttgaatagaaataaaagtgccaactaggccttcattgtttctctcccaagacagcagaaggagagtgcccgtgtcagaaggggaacaggctggggagctgggcagcaggggtaggtgatgagacaagtttgggacactcagagttaaaagtttgggaggtaaaggaagtgtggccagtgaggcggagaacacagaggtggcatcagagaaacaagagagggaagatttttcagggatgtcatcaactcttcagccagcggaatgcaggcggagttgaagaagtggaaagagaagtcccccagtgctatactaattgtgtcaccaattgaagcaccctgctttccctattcttgcatctaattgcagtacgctaccatgaaaccagttcattctgtgctcaatttgctgttctgcttaaagggacttaaacttgatatctgaaggccaactgctacgggccattacatttatttccttccaggcattgtatgtagataagcaattaaatgagggaaaagaagttgagagtcatttatcatggagaaaaaaaaaaaaaaaaccattgaacaaggctgtacaagcaaacctatttggattgaagaaaacataacgtttaattctcagaaacaaatgcaagcatcggtccaagtcttccttcccaaacctttgtcatttagggattgagaagctgagttgggtgaaaggttgaatagaaaacaaaaaggaaagctagaaacacgctgagctcatggagatgcagcttcttctgtagctcctaaagcccagctgaggtatcatctaatgagaattctctctatgccaggcactgcgctaagcatttcacatcattaagcaatgtgagttttaggcaaccccgaagcaggcagtctgttcatcccaattgcagctgaggaaacagggtgagtgaggccaagcagctggcccaaggtcccctgcctggtaagtggcacagcctgcagccctgccaggtggtcccgctaaccaagccggcgcttttctgtcaccatgccgtatcgcctcctgtactatcaaaatgtactatcaaatttacctcaaaagaaaaccctctgtcttctgagaagctccggaaggtccaacacgttgcctgccaacaaaaaaacatgaagagttaaaaattagctatcgtacgtaaattattagccatttacattgtatgtaaattatgtttcattaaactttaaaaattagaaaaagattttcttctggtagatttccttaaaaaagtgttacctttaagttttacacttaagtgacccatgttatctgttttaatgaataattttcctaatagaaaattattatgtggaagacgacgacggtagcgggtggcaatttaggataaaaagtgatcaagtgaactcaggacagcgaactctttctaactgtgcacaaatataactgtctattctcttcctggtggcatcaactcaaaatttcagttcattcatttattcagcaagtatttataaaccaaatgaaccatatgaaatcgccattcttgtaggttaaaaatggtcatatgtgggtaattccaaatagttcaacctaatatgaagaaccctctgtgtggtagaatagataatatcatgggagctgggaatatagtgttgcataaatggaccaaggtcctgcctttatcttgctacattctggtggtctaagacataaacaagcaaaaagatacattaacaaaattatcccaaattgtgataagaaataaacaggataaaataattaataacttacttgaggtgaattgaaagctacactgaataaagagatcagaaaaagtaaggtggatggaacatcagaggaagatcattccagacaaggggagaggcaggttgaacgtccatgaagcagattgaaactccttagcagggccctgctgagtgaggggacttgttattaggggagttcagagaagtaaatggaagtgagttttgtagggcttcaaggaccctgacaaagagtttgaattttattctaagttagaagaaagtcactgaaggctttttgcctaaagagttgacatgattcagttaatgtattaaaatataacttatggtgacgggtacagtggctcaaacctgtaatccctgctagttgggagggtgaggcaggaggtttgatcccaggagttcaagggcaacagaaggagaccttgtatcttttatatctatatctatatccatctatatcttatgggtaaaggaaatattctatatttttatcatagtggttacatgactgaatttatttgtcaaaagtcactggaatgtatacctaaatatgtgaattgctgcattttactctatgcaaattgtacctcaaaaaacctaaccaaaaacaaacaaatgaaaagataactctgagctgaagccattaaaaattatttatctggaaggtattggtatgtcttgtttgtttgtttccttttggtggtatcatttgttgaactctgcctgcttaaactctgcacatgtattttttttgtaaaattaaaattatattttatgaaagataactctggctactgagtggagaggaatttataagacagcaagactagagactgggagaccatttaggagactatggcaagaaatgagactatggcaagaaatagtcgtggtggtgatagtggaactgagaaatgggaataacattaaaaacataatttggaagtagaactgacaacacttactgatgggttggatgtgggcagagggggtaaagaaaaagaaatcaaggatgacttttggggtgggggtgtccacatggacaaggcatggttgaaaagagggaacaaacagttcaatgaagggtttgttttggactttaaaatatttgaggtggctatttattattcatccaagtggaggagtcaagaaggaagttggacacataggcctgcagttgaaggaagagatgaggactaaatctgtatgtcatcagtatacatacgatgtcttagtcactttgtgctgcacaatattacagactgggtaatttataaattatagacatttatttctctcagttctaagggctgggaagtccaagatcaaggcaccagcaagtttggtgtctgatgaggacctggcatcttctcactgtagcatccttacatgggagaaaggagaagaacaaaaagagcttagctagttccctccatcccttttataaggttctaattcatttatacaggcagctccctcacgacctaatcacctcctaaaggccttgcctcttgacaatgctgcattggggattgagtctcaatatgaattttgaaggggacatatacattcaaaccatttcacatggtatttaaagccttgggctggattgagatagaagaccaagggtaaagaagagggccctatagcactacaaatttggaagactagtagggaaggaggatcagccaagcagggagacccacattgtctgttccaagaggtatatacatttaaccctttgagtgttgaatctgtgaattagtcagtttggctgccataacaaaacaccatagactgggtggcttaaacaatagatattaattttttcacagctctgaagagggaagaggaagatcagggtgccagcgtggttggcttctagtgagtgcactctgtgccttgcagacagctgccttctcactgcacgctcatgtggcctttcctcggtgtttgccatagagagagctctctctctctctccgtctttttatgaggctacagtcctatagaattagggtgccacccttatgactcctgtagccttagttatctgccaagaaccctatcttcagatacaatcacactgaggattagggcttcaacgtatgagtttgccaggggaggacacaattcagttcatagtaacctgcaaggagacatatcaggggcacattcttgtcacacggccaaacttccattgcaaaatgactacattacaatggatctttatatgagtgtctagcacattgttgcaattattcgatgaactatcattttgaatttgttcagctgcacttgtggaagaggaggggtaggagatgaaaaagaagaagaagagcatcgattgtgtactcactctgtatcaagcactgttctaagtacttttgcatgcatcactacttcgtccagtttttatgataaccctttgaggtagatattttgttttacagatgaggaaacagaggccccaagaagttaaataacttgcttaagatcacagagctaatgagtggcagaacaattattctagctctgattttaagggatttacttaacttttacttggaattcatggagtcattgggctttatttaataagtatctcatcatattctagttatatcatctcctataagtgttcaaaatttgacaaaattcagatcaaaggtgttttgggggcattttggtgtcagaagccatgaggccattaaaactcatgagggctgctttagtttcctagggctgccataataaaggagcacaaactagaaagctgtacatctgaaatcaaggtgtaagcagagccgtgtttcctctgaaacctgtaggggaatccttcctctcttcttagcttctggtggttttatagcaagctttgacacgtagtgaaatctgacacaaattaagtacataagaagctgttccttggttttcagctgcataactccagtctctgtcttcatcattgcatggtcttctccttgtgtgtttctgtcttcacatggccatcttctaataaggccaccagtcatattggatcagaggcctaccctactccagtatgacctcatttttatttaactaattatatctgcaatgatcctatttccaaataaggtcacattctgagatactgggggttaggaagatatgttgaagagcatgtcttttttttcggtgggggttggggaggatacaattcaacccagaattccagacaggggctttgtggatagagtttataatcttaaggaagcacatcccttatttcatctccccttttcccaatcctaacatccacagaaaatttcctgccagcagttccttccttgggtttaaggattccccaatgccagatgttaagtctgctaggaaatctgtagaccacagggaagaaaatgcaaaaagaaaataaagtcctcaaatgcagctaaaaattgctagcttctatttttaaaataaagcaacataatactttttcttccaatttatctaccttcaaaagtcccaacaaatgttgttcgtagtactgaaatctatcatttccctttattttttccattcttcaaattgagctattaagtcaaatgctaattacatgaaacattgttctctgttaataaacgttttgagaagttctgccgcctcaaataaacaactaaaacattaagtcagtgtggcatttcagttgaatagggaaaaactagattacttaataaatggtacagcaatatttggctaaccatttgggaaaaaataaaattagatgcctacttcacaaattaaatttcagatttgttaaagatttatatataattaaattaaagacagatccttaaaattcaataaaattttaaaaattgcaaaataaaatatgtggctatttagtgtatttgggtattgggaagtcttttgactagttataaacactaagatataatctacaaagagataaatcaacttacaaaaaacttaaaacttcatggatatatagaaagcagcactataacatggaaaaaggaaagatgcatacagtatatgacaaataatatgtttatattatgcatataaaaacacttacaaataatttgcaaattaatgttccaacagaaaaatgagaaataattttaaaaggcaattcacaaaagaagaaatacaaataaccattaaacatatgaaaagatgtttctttttacttaaaaaacaaataggatctttcaggcctctttcagttctaacacactgtgattctgaatacaaaggtttcagttggaacatttttgcatagatttgcccttgaactgatcctccagtgcaaaatactttaattgctaacgtaaagtttcataaaagcacataaatctcatttattatagttctaatatgaaaatctggatctctttagaaccagctttattaggatctcttggctgcatatgtcagaatctcaactcaaactctcttatgaaaaaaattcagcagatgtctaccacctccacacattcctacatccttaatctccctgtgttttaaaactctaaatgagttctcttagaaatataaaggcaaagacacctcattcttctctcttgctgagtggagaagaattaaattctcatacttataagtcgaacagctttaagtagaatagacatggagggccagctaacctctccagcgacttcctagtaatttaacttttcagttccagaagtttctagaagaaaaccccattcctggcttaactcagcctataacctgagcctctagttgcagctcactgaagcaccataagaatagcaaccatgtgtttagaacagcaaccatacgacagcaaccatgtgtcatggcttattctcatcaagcctccaggttgtagggagcttcggtgattatatttttgtttaacagccctctcacccaccctcctcttgggttccttgggtaatcactccctctctttccatgtggtccaggcaaacctgtcaatcacaacatcttcaccaccttccccttgccaaaggcttacaacccaagccagacaatcagaatgttcctagggttggattaattgttgttaggagaaaggcacttttagccatggagcaggcaaactcaggatgagaagctgggctactggtggccaaagaaagtgatttctcacaggagaagttgaggaaagaaacagggaggcagggccagagatgatgagggagacagagaactccgtaaacaggagtaccgaagtttgttgtagccccggacttcccagatgtgtaagacaataaattctctttttgcttactagcttgaattgggtttctgtcatttaaaacctaatggctccaacttgtgggcacttctgacttacagggcagctcccacagacctcagtagctttaccagtcttccttgtcttgtgagctaccatcttctactcttttgggagtgtgcgtgcatgcttcggattatcaaatgatttcaatgacaacaaagaactgattgtagttttgttcttccaaaaattcatctttcacttccaaagaagtgagatgtattttacacacacacacacacacgcacacacgcacacacacactgcatttctgttgggtccactgattcatgaatttaccctgacactaaacattcctttccattctagttttcaatacagagccagtttcagcaagcttagaatagcaggttctttgctgaaaaaaatattttgtttcaggcaagttctgtcagttgatgattgctatattacaaattacccccaagcttaccaattttttttttttttgagacggagtctcgctctgtcgcccaggctggagcacagtggtgtgatctcggctcactgcaagctccgcctcccaggttcacaccattctcctgcctcagcctcccgagtagctgggactacaggtgcccgccaccacgcccagctaattttttgtatttttagtagagatggggtttcaccatgttatccaggatggtctcgatctcctgacctcgtgatccacccgccttggcctcccaaagtgctgggattacaggcgtgagccaccgcgcccagccaagcttaccaatttttttaaaaaacaaatgtcatctcacagtttctgtgagtcaggagtccaggagcttcttagctgggtggttctgcctcagaatctcttacaagacttcagtcaaggtgtttgccagggctgtagtcatctgcagcctcaactggggaaggatttgcttctgcactcactgccacggctgccagcagtcctcagttcctcactacgtgggcctctccacaggctgcctcacggcatggcagctggcttctccgagtgaggagtttaagagtgaaaaagtgagcacgcacctcccaagacagaagccacagtctttcaataacctaatctcaaaagtgacatttcatcctttctgccagatctatctgagtccttatgtccagcccacactaagaaaaggggaatgtagctccatctctttgggagagaagcatcaaataacttgtgaatatatctttaaaaatcaccttacaagtggtggcgctcgcttccccaaagagaatctgagttctttctaaaataccaatcctttgttaaaatgagatggagagtagatgagggaatgcagcggcaatagggaagacaactattccaggcagaagagaaatgctgtatcatccacacacattcctcaacatacctaaagctacctttaatggttttaagtaagaaaatggctgagggatttaaaaatctttactgggaattagaaagcccctagcaatacaactcagtaaactggcattaagatacagccatgcgattatcgtggatgggaaaacggcaagattgtaacaatctgcaagcatgttgattgatcagagttgcaaagtactatcagctggccgatggcatacacaaagtgcagaggagctctcaactctgtaagaagaacaatgccggaggagtagaatagctatccttagcccaggtgctcactgcccctgtcacgtatgctcatgccacacctgagataccgggagggcagcgtcttgtcctatgtcctcccattactttcattcccaaagtatttctgcctatagagctcttccggcctctaaactccttccagctgtgtccaaccttttcaatgcaaggactattttgcttatctgtggtggtggatatcatgaaaactatgcatggacctttttttttttttttttttttttttaggtcatcagctattgttagtgttagtgtattttatgtgtggcccaagacaattcttcttccaatgtggcccagtgcagccaaaaggttggacacgcctgcaatacttagtaatgtatatcattcatgtggtgataaatatattcagacgaagaataattctttttttaaaatgtaaaatcacaattatttgatgtttttcatttgtgaatgccttttacacgtagtccctacatttaggtgctttggatgcatgacttttcactagaccagtggttctcaaccttggctgcacattagaatcacctggaagtttctttccattccaagattcaacacagaaattaatagaatactgaatcaatttcaatgaactaagagtgacaatttttactaaaaaatatttacttagcaagaagccaagattgactgttgttttagagtctttctactcgaagtgtggcctatggaccaacagcattcttatcagatgataagtgagctgggagcttgtgagaaatgcagaatcccaggccccacatccaaattataatttgcattttaacaagattcctgggtgattcatacgcccattaaaatttgagaagcactcatttagactttcccattacccttctctttatcactctgaatattctccaacttcctatctagtgaccacagagggtactgacagattacagcttcaaagcataaccaggatcaatagaatacattcattctttcattccagaaaaatctatttagatgtagggccagtgcctatgcttgtgcagactgtgcaccacatctgggaagtactattcacaatgtagaaattttacatttggattttattgctacaccattttctagcagacggcagtacagtgtcttgcaacaaaatcaatacacataagctttggctgaatggaagttaagtgcttgaggaaggaatgtcttttttctattcaatggcctataggctagatgtcaccttaatgggagccaggacctggcgacacagcagcaaaccagagaggccaaattattaactatttcccatttaatacaatttgtttattagtttttatgcaaaattatggtatggtagtttttaaaaattcaacgtatgtggcatattttccttccattgcatacgatatagcctacaattttaatgtttaatatacaaaacacagcttgtgtttttttcccttcacaaagtttataacaaatcttggagcacaatctgtaattacaatacatcgtatgcagaaattccagccactttcgagctttatactttatggtgtagtttccaagtacacgttatagcagaagtgaaagaaaaactctatttttctgaatattctataattcctgtcatcaagtgccttggatgtggacattagagatcagtcaatatttgttttaaaacagtattttcaacttcttttatatacttttctgtctctctctctctctctttctttttttccctaatggaatgctctgtcctgcttgccagttttggtgcagagaagccaacaaagatttataaatagggatgctcatgacatcatgatttatgacaggtaaaaacaggaagcattttagatttcaaacaaaaggtagttgatcaaatatatcactacacatccaagtaactaaatagcacatttattaaaaacgatgagtctaaagaataattaatatcatagggaaaacatttatgtaaaatgttaagcaaaaagttttaagaggttaaaaggaaaaaaaaaatcagggtgcaaaaccacatacatagtgtaatctgaatgtccctggctccttgctacttagctagtctacggactagcatcatagcatcaccaggagcttgttggaaatgcaagattttaggctccaccctaaaacccactgaatcggaatcttcaggtgattcttaggcactcgaaagtctgagaagtatcacccaggccgtatcaacttcggggaacagtggtcagtttacttctacaatttgaaccaaagttcattagctcattagcaccgacctacctaatgcaggaccacagtccccctccaagacacatccagtgtcttaggcaggtatctataagtataaactcaggcactggggtggtggccttacctgtctctcaaaatccccaagggggaaatgctgtttgatacaaatgattatttgaaaattatgtcaaagaaagggggatctatttcttttgccctggcaatccctcattaaatatgccttttatgtcatctctgcccattcgttttcctttcggcttcctcctatccctcacacatgcctctcctctcttacctgagaatcctgagagagtcgaggaggaaacctggtattccagagttaggagaaacgactgtgccctcatgtaccatgatggatactatcacagaaagcaacatgcatgctctcccaccatccacactgggacgtgagcatcactatccctttatcatcccaatggccactttgctgcagcaccaaccttgctgatgtgacccattctggtccactgctggttaaaaactcccctctgaccactgcccacatggttggatcagtccaccgtggacccaagatgtgactctcactgctttacactgccatgtgggactctataaggtcactactctcctgataggcatgtgggatctgcagtgtgggatcccccatgcctaccgagaaggagaaatgggggaggatataggtttaagtagaaattagacaagggattgggactagagaacatttctcctgagagttttcaaggaaaatgacttgcctggttatgttcaagcataaagtatataatacaatagaaaacagagtaataggagttaggaaacgtagtgtcttgtcttggttctttgtgtgaccttggggaagtcattttcagatgcttatttttccccttttggaatgctgggtaaaaataattgcacagtccatctcccaattctggttaagttcaaatgagatgatgtttggaaatgagctttgaaatcccttaggtgtagcattagcaccattaatatgcagcaccatggtaagaaaaaaagacagtctgttctttaaattggcctcaagaaaatttcacacctggatatctggtggaacctgcaaattggtgttgtatattttaaagtcaagagtaaccttggagactggtctagattgaaaatcaacagtacattggagagtgatacacagctcctagctggtaggggaaattgagggcatccagagtgaataaagtgtttattgcggtggagtgagcaggggggagtagcattatgttctaaaaacattcaataaaagaatagccaccttccgttttctcaaacatctatgcaggtgcttagatcccaaatatggaagattttgcatttcacaaggtatctttcattctacatagatttgtagcaaaataaaaatcattatacattttaatggctttgttgatttggttaaattagctgaaggcattgttgactgcacataaaatccatttctcaaagttctttagctttttgaccctttcatcaattcttcttcagttctgtcatcattctttccctcctctttcaatttcctatctaaaatgttccaaaataattataaaagtcagagaggcatgatgaacctttttattggaaagagatgaaccttccaaactcattctcagctcatcatcacagcatttggaatatggagtaaaaattcatattttgcaagtgccttggtgcttaagcatgcagaacagatgtttcatttcacaagttttcccaatttattacacataatatctctatttctgtgagacaaacactgctttggggaataggcctctccatttcctccagcaagctaaggcatggaaatggactgttgagtcaccttctagtcacctcaggagaggagatttttcaaatgctgtttgtttattttcatgcaaggtcatcaaggggaaatagtcacagtcccatactccttaccaaaggccgtcacttctgcacatggcatttctctacctgaaatgcattcaattaaatgcactcatccttgctaggcctggcttgatttcacatctgtgacggattccttgatgaactcgacaccgagtggtttcttccaatagctaaataatacctgatgatgacattattttcatcattaccattagcaacttaggagggagaaaggtggtgttgggcagggaagtcacactaacctcacctttccctgttgcactctaaattccgagggcggggtggcttgcacagtgcctttcatatgattggtgttttaaaaacattgcttggttgattacataggatagtattgctgctttggtagcctaactttgctcctacactacggccagaagagagggtgaagaagaaataagaaaataaaaatcaatcctaaagaaagtggtaaggagcaaaataggagttatcggggaagcacaaaaacctgaagcagataaccctcaggcgtgaaggcctatttctctcctggtttacacacgcacccacctccgtttctctcctacttctccgccaccccacctcaaccaggaggcaattccccaaccaaccctgaatatgtcttctaatttcatgtactcaataatacccaaaccatttaatctcagtcactgctggtgggagcggcaattgacacgaccttgaagggaaagcaacttggcagcagatatcaagagttctaaaaaacatttatactcatcttctccataattccacttctgagctgtatcctaatttttaaaatcttaaatatgtacaaagatttatgcccccagagtttccaatacaggtttatttatacagagataggaacagtgcagcagtctagcatcagaaggagtggctaaattatgggatgagtctctcactggaatttttctaaagttattttaaattatgtcttaaaggcatttaaagcttattttatttttaaatgtttttaaattagcatgcaataaaattgacctttgtctacacagttctatgaatttcagcactcacatagggtcaggaccgagtttcctctcacaagactcctagccccaccttgaaatcaccggacgcgcttcgttgtccaggagccttctcgaagcggcgggacgtctccggaggttgggtggcccggtcagtccgcggcacacaaggacctctagggggcagtgttgtctcacaccacatgttcctctaccgggctttaacacacacccttaaactctaacccagccaaagcactattgcgtctgtattttccaaatactttacaatgagtatgcactactattacaatcagaaaaaaaatattagattactaataagctattgaaactgggggagatagcaatataaaaatacccactcatggaagacactgcttaaaatagagaactagcctctgttcatagtctggtttcaaagcccaaagttacgtttccttttgttagattgctagatgatatggctctggactttaattctccatgtttaaaatagcatttctgtatttaaaatagcatttcaatagcacttttaaaacttctaaaatcatttctgtaatactcttttttcagtgagaaatagaacaatgcttcttccctctctattttagagatagcaaagcgctaaagagatgaatttgtgttagaacatctatatattaattcagaatatcctaataagcaaaaggatattgctaacaatttgtatgcagcaaggcataagttttggagtcttctcaatttagctattccacttatgctagttcacccactcccttcctgtgacgggttccctagtgatgaatggggcatgtagattatcagatgagtggacaggaaggaagacagtctagagtggaagataaagataaccaacccatgatggaaccaactcagaaatcaaccccaccaagagaaaactttattcatgcactgaatatttatggaacacctttcacttgccaagcactgttccaggtgctggggatatagcagaaaactgcacgtcaaaattgctgctctcataaagttcacattctgggactctaacccagccaaagcactattgcgtctgtattttccaaatactttacaatgagtatgcactactattacaatcagaaaaaaatattagattactaacaagctattgaaagtgtctcccactgggtgggagacagctaggaaaaagaaataaagaggaaaaatatcctcttgaaagttaaaataggatagagacggattggtgggggctactttagactgcggagtcacagaggacctctttgaggaagtggtaatttaagatgagatcagaataacatatccagccttgagaagacaagggggtggagggagtgttccagggaaaggagacaccttatacaaaggctggaacaaattgaatgggttcagaaaacaaaaggaaggcccagagtgactggagcgtggcatttagggatgaaggtcaagtcagaaaagtatgtaagagtctggtcaagtaacagtctcgtaggccaaggtaaggaatttgggttttattttactgcagtgagagatataggagatttcacacagaggcgtgaaatggtctgatataggtttctaagaaccattctgatggccattagaaagtgcaagtttgggaatatggcgatcactgagaaagctatgggaccgtgcatggtagatcatgcctgtaatctcagcacttcggaaggccaaggcaggaggattgcttgaggccaggagttcaagaccagcctgggcaacacagtgagacctcatcgctacaaaaaataaaaacataagccaagtgtggtggcatgtgcctgtagtcccagctactcaggaggttaaggcaggaggattgcttgagcccaggagttcaagactgcagtgagctatgattgcaccactgcactccagccagagcagcagagtgagaccatgtctcatataaaataaaataataaaattcaaataataaaataaaacagaaagctatcacaataactgaggtcaggtgtgatgaagtgtggaccaggattatggcggtagagatggaaggtagctcacagagtcatgacatcttttggagaaggagctgttggaattagctgtattattagatgtacatggttggggggagatgaatcaaagcacgattcctagctttttagtttgaacaactgaaaggatggtagctccatttccggagatgagaggactgaggagatcatgatccggggggaatatttggtctttaacatgtgagcccattggacgagcatttgggtaacttcagtcttactcctcagcagctgctgttggcagggtgtggtcaggtaggctggcactgtgtctgagcaagccagctctggtctgataacagagttttatctggaaggggaaacccagggctgggcttacgatctaaggtcagcagcctgtcacaccaagaaataaacatctgttaaggcaattggtacataagcactcagaaagtgtagcttgtcaaagtggcttaattccaactaggttgttattactcagttgacacctcttgggagagttttttgatattttctttaactctttagtgttatactttatgtatattcacatgaattgaaaacaggttcagttaaaagggtaattaaaaatataaaacattttttaaaaaagaaaacagggccaggcacggtggctcacgcctgtaatcccagcactttgggaggccgaggtgggcacatcatgaggtcaggagatcgagaccatcctggctaacacggtgaaacctcgtctctactaaaaatacaaaaaattagctaggcgtgatggtgggtgcctatagttgcagctactcgggaggctgaggcaggagaatggcatgaacccaggaggaggaaggagcttgcagtgagccgagatggcgccactgcactccagcctgggcgacagagtgagacactgtctcaaaaaaaaaaaaaaaagaaaacaggtacatgatgtagactctacattttaatgtaatgtttcattaattgtaatgaaacattacaatgtttcaacatccttgaaatttaaataagggaagctttgggtttccataaagagaacacttatacttaaacacaagaaggctgagacaaaggttaaaaaatggtaaagctgtaaagggctgttaaaagcataatgctgtatttttcatcccccaaatcttaaaatgtaaaaaaatggctttagcttttgactccaaagctggagattaattttttaatttttaatttttgtgggtacatagtagatgtatatatttatggggtacatgtaatattttgatacaggcatgtaatgcataataatcacatcagggcaaaaggggtatccatcacctcaagcatttattttttgtgttacaaacaacccaagtatactcttttaattatttaaaaatgtacaataaaattatttttgactatagtcactctgttgtgctagcaaatactatatcttattcatcctttctaactattgtttgtactcatcaaccacacccacgtacccccgactcttctcctactcttcctagcctctggtaaccatccttctaactctctatctctatgagttcaattgttttaatttttagctcccacagataagtgagaacatgcgacgtttgtctttctgtgtctggtttagttcacttaacataatgatctccagttccatccatgttgttgcaaatgataggatctcattcttttttatggctgaatagtactccactgtgtatttacaacctttcctttgtccatttatctgttgatggacacttaggttgcttccaaatcttggctattgtgaatagtgctgcaataaacatgggcgtgcaaaactggagaattttgaagtaatacatttactcctacagagatcctgaataatcatagttcttgattacacccacctcctcttcattattttaagtatttttgttaattactaagttgatccttctagtaaaaaggctgccacaacttcgtttcctttggaggactgagaccttcccaccttagcaagagctttccatgttgaggtttgcagtgagagtcacattacccagagaactgaggggactgcagttatgcccttgcagatacgggaacacgagggctgaattaatgagccagagccatagacaatactgccaaaaagtcccaagttcccccgagcaaatacccaggaaggatttgtctggatatcaccttcacctcctacttagaacagggttgccctgaaagtccctccacccatcgcaggagaagaccttggagagtggctagcagaattcaggcaaattctttgtttctgcattctatttgagcagcctggccacaggccaaggaaaactctcttggagaatagacattacctgtggagaatgatttgagaaactctgatccaggaatatccaacactacagtggcctcctggggtccctactaaccggtcccctattaatctccctgccctgatttcctaccatcctctccctcactcactctgctccagccactctggccttcctcaaaaacagacagacttctaccttgaggcttttacatttgcctagaacactctctagcttgctcgtttacctgcgtcatgtcttggctttcatgccactgtttgaacaaggcccacccttattaaccccaatcaatattgcaaacttccccttcaccactcaccctcaccaccctcattattcagctctttttttaaaaaggtacctattatgttctaatacatatcactggggtatgttttatatttattgtatattgtctatctcctcccactagaacacagctccacaaagggtgaaatgtttgcctgtttcttggttgactgctgttacccctgggcctgcatcagcacctggcgtatagtagactctcaagaacagctgtcgattaaatgactgaatatagcacatctgggaaaacaaaggcttgatttggtccctgttttcaacactagctctccctcccccaggactggtcctctcctagcactgccagcctctgccagtccttagtgggacatgacctgcccttgcccacacacctactcgatcctcactcagtagtcagcatccatatcccactgtgactgacccaggcacacagtgccagcagctcgtccaaactggaaactcttcaagtctcaaagtcttttatcagtctattacttgtccctgcattctctcttctgtccccctcactgtagaccttcagacactcaccaatttcctgttccctctctcagtccctgggaagaccggcagtggggtaggacgccaatctccccagctgctcttccaggctcccctgccagaggaggcctttggtctgtgatttttctgccaattattagaaagaaataggcctgggataataaaaacaaccaaggaggaatttaaaaggttatgaaatcttttaaaattctgttttctcaattgtattttctcatttgtacttctcggctcttttttgagacgtttacatagaatcatcatctttccttatatactcccttttggaggaaaaagtactttcagagtttctcaattatgtcaaataacagaaaacatttattgaacaattactatgtgctcagcaccataatgcatttctatgaaaatgagctcatttaatcctcacaacctctcggtgaagtggatgctgtcaatcttcccatttcatggaggaaaactgaggcccagagaagttatatgactcccgagtttacacagctacctagtggaggactctaagttacaacttatctaatttgagagttcaaattttcaactgctataaaatatctctgatacatgagagaagctggaaagtgagatcataaccaccagaaaaatactacttgttagtgcctcagaagaactaccactggtgtgagtagaattacaacactggcaacccaaaagagatacgcatgtcatgttgtctgattttggagacattcttaattttcagtggcaggtgccatacatttattcattgagcaaatgttttactgagtacctttaatgtgacaaaaagcctggccactgcagaaacaggtgagcaaaagcaaacacagcccttgcattcatacaacatatatttcttcttgaaatcaagttcctggcactaggtatcaatagacttgaaaatatgcataaccagctaggtgcagtggctcacgcttgtaatcccagcactttgggaggccaaggcaggcagatctcttgaggtcaggagtttgagagaccagcctggccaacatggtgaaactgtgtctctactaaaagtacaaaaattagccaggcgaggtggcgtgtgcgtgtaattccagttacctgggaggctgaaacatgagaattgcttgaaccagaaaggcagaggtttcagtgaaccaagatcatgccactgcattccagtctgggtgacagagagactccatctcaaacaaacaaatgaacaaaaaaaaaaaaaacaagaaaatatatttagcctataaccaagaatctcatttctagaaataaaaataatctgaaacacaaattaattatacatatttatcagagcattatttgtaatagcgacaaattagaaacaactcatgtccaaccagtccaactcaatgattaccagtaggtaaatcattaggtaagttgtggtacatccacatattgaaatagtcattcataataatgttttcaaaaagttttaatattatgaacaaatgcttaaattataatgttaaaaatgagaaaagtaagctataaaacaatctgtttagtatgctttttggtacataaaataatatatatgacattatttggatatgttcgagtaagctatatgatattaacatttttataggtcaaaaggatcaaatatcaacaatttcataatggaaaaaatctgaaaacaaaaaagccaaaatattaatggtgatgatttcttggtggtggtatcatcagcaattttcactcttttccttctatttttggcattttccagttttcaacaatgtacatatatttctaataaaaacattattggaaaacaaaaagagaacaaatgttcctctttcagctactttactaaatcataatgctaaatgcagtctgactgagtacctataatccatcatgccagtaactgcagcaaatgtagcaatggcctgtaattccattttatacatactgcaatagatattcagcccagaacgatatttcaagacagcagtttctgaagcagggagttggttcagataaaatagatgccagactatcagtgcttcatagccttagagataggttgctaggacctaactcataacatttccaagaaagctgcataaacttcttattgatgatctcaattacttctaaagcatttttgagaaaaaatatttttaggaccaaaataaaagtaggttataaagtcctagctcttgaggacaatggggagagaaagattttatatgctggaaagaggggttttttttgatagattatctgaaataacatatccttcattagtcagtgctaatgaatagtcacatctgttttcatggaacaatggagaattacataattaatagtttattcttttcaaaatttaatataactgctccttttacacttacttttaactctgtaagttattctcttactgtctttatatgtaatataggatacacttgcccaaaatcttgtagaatacatgagaatatacatacactaaaatgtgtatgtacacatatatatgtatacatacacacacacacacacacacacacacacacacacacacacacacttcacagtttaatgagtgcttactatatgccaagtactatgttgagactaggtatagaccagtgagcaaaactgacatgtctcttacagcccagtagcagagacagacaaacatgcaaatatatgcaaaattattaattgtgagaaatcaaatgaaagccaagaataggacactgtaagaaagaattcggctgaaggagaattagactggagagaacttggaatctgaatcaacataggatgatgtctctaaggagaggacatttacacaggagaatgagtggaagaaaaagtctcctgggcttaagaaaagaaggtcctgactcagtgataaggagttaccagtattaagagaaggtcagtaggcccagtgttttcttgagcaaggtagagggtcatcaaatggtgtttggaagggaggcctgggccatgtgactcagaagtctacaggtcctgtggaggatttatcctaagtagaataggaatgtgctaaagtatttgaaacagggaatggcatgactagagaaacatttttaaagcattattctactgaagtattctactgggctctaatggttctactattgtattgggtgaaattctgtgatgtctggtgtttgctttaataaatattccagatataaagaaagaaaatgtgggagtgccaagggaaatgataacagataaaataaaactgtcaaaatattgaaagttgctaagactgggtgataagtacatgggaatttgttatacatctccttgtgttttggggtatgtttgaaattttttaaaataaaaagctttttttcaaaaagataaagagtgagctttggctctgagattaccagttcaattctgccacttactattaggtatgtgattttagaaaagtgatttttcttctataatctttagttttcacatgtatggaatagtgataatgacagtacatacctcataggcctgttaaatatattaatgcaataatagcagagagtttggctcatagtaaaaatctggggaatgttaactattattttagaattaactccaggcatatttattgtgtgtatatatatatatatatatatgtgtgtgtgtgtgtgtgtgtgtgtgtgtgtgtgtatatgtgtgtgtgtgtgtgtgtgtgtatatatatatatatatatatatacacacacacacacacacatatatatttgttttgttctgttttgagacagagtctcactccatcacccaggctggagtgcactggtgtgatctcagctcactgcagcctctgcctcctgggttcaagcaattctcacgcctcagcctcccaagtagctggaattacaggtgcatgccaccatgcctggttaatttttgtatttttagtagagatgggggtttcaccaggctggcctcgaactcctgaccccaagtgattctccctccttggcctcccaaagtgctggggttacaggcatgagctatcatgctctgcatatatatatgtatatgtatttaaaccattctggtgtctgtatggaaaatggatgggagcaatgaatggtgacgtaaaagatcagttaagagcaattggtgagttcagctgagtagcactggagcaatggggaaggagtgacatcgattaaggagccgctggaaaatggatggtgctgaaagccctgcaaaaaaccaagatctcctgagatagttcccaggggttcttgactcctccaacttttttttttttttttttttttttttgccatggactcctttggcagtgataaagcctataggctccttctcagaatgatgttttaagatgcataaaataaaaggcataggataacacagaaaattatcttgaaatacagttactaaaatgtttaaaaagtaattttcgatatagtaaaaagttttttaataatgtattaagtaactagatgcatatatatttcaagctatctaagtataatgtgacataaaaatattgattctttgtattagtaactgtcacagttcagtttccccagaaagcagaatctaagctggagattggcatttggggagtttgctagggaacgctcttgacatcaacatgagggaaggcaaggtggaactggtcagagaaggatgacattgagctgtgatgaagtctgagaggaagcttcagccaaccttacagaaggtctgaagattatatgacccttcagaagtgccctgaatcaaagagggccaggtgtttattacccagctgaggtggctctctgcaactgaggccatttccctggggctgccagctgagggcactctgccaacagctttcatagtagctggggtaagtcctcatttctgaaagaagatctaggtgtaacattataacatcaatcacagtgacaaatttataggttctgcaagttccactgtggcttgctgcctacattcacagttgaagaaaagactgaatttcggttagagattagtggaaatgaaaatgtaattttaaaatcctatccaaattcacaaaccccacatggaccccaggttaagaatacttgtgagtgagaatggggccccatattcagagaggctggtcaggctctgttgtttgctggaacacagtaagctgtcttctgctgtagggaaaaatgagcagattgaacctaagcattaaaataaaaaaatgagcagggaaagtgtgttttccagagcaagaatgatgcccaggaacaaagcaagtcagacaggatagagtccacagtaccagagaaaagacacagattgatgtgcagctgcctgagtctacttttgaattacagattttaatccttcatgaaaccaaacaatacctccagttcttggtgtagaaacactcctatgtctttataatgttattttctcatgtaagctagtttaagtaggtttctgctgcttacaagctgacgtatcttgttgaatacagagatactttaaaactcctcccttaacacacacatacacagaaattcttgaaatttgcaggagtttggggtgaggagcatctagcaaggaacatggagttgggaatggttgaagcattgctgctgggatctattaaggctctgagctctccatgaaagtattggctttctctttgatggcctttgctgtattggataactcacctacaaaaatgacttatttttaatgtagaactgtgataaacttcaacattttgatgattatcatgctttaaaatgagaataaagatagctattatattttttaatttgacagagtagtgcaggcaataatgaaatggtattcatctgaatagcaatctttatttttaaaatccaaaggcactcaataatgtgatctgtgcactttgctattatgatatatagcatataaaatgttaagcacgtctaacatttaattcatttcaatcataccagtctgtcaagatataataaatcaacaaaaccaacaactccctcccaaacattaattacctagtgaactactcttagcttttttatttagtcatgaaatttgaaaattacctctgaattagcatagctattcacacattattttccccaacaacaaaagaaatgccactgtaacagctgcttcgtactttttaacatgaaattgatgttagtgacagattttcaagcatgtaatttgtctcaacatgtgtgtccttttatttgtaaaaactcccaggactgaagaatgaagtttcaaaaagttatttattgtgtctcctggcagggtagaatccatggaaaacaatcaactaacagaactgtgtgatggtctataagatttggaattataccattgttatagaggggaaataaaagacatttctcctgtaccagcttctcctcccccaccacccctagtaagaagtggaaaatgaatataccaaatgaacatacttggatttgattttatgatttgatttttatgatggaacgtcttgtaaatgggagcagattcctaaaaaaattacagtgccagcccagttctaagcactgcatccccaattactttgaaaagaggctcttgtaagccaactgtgcagtcacctctgattataaggtttggaaggagtatcttccaggacctacccttagcctgattcagcagatgacaatccatttccttttaaactttttttttgcatcagaagatgcagtaagttgtaagtattacacagaatacttaggcacagaaaacacaataagtagtaagatgtgtctcttaaggggctcacaattaagtatgaaaagagattattagagaaacaaagagttaaatcttctaatagaggtggtggtagaaaggtgtgttgtaaccagtctctggtcaaaatgaaaccaatttcggctagaggaagcagggatctggttatacagaacccaaaggacttaaagttggtgaaaaaaggaagcagcaagtagagcaaagatgggttgtccaactccccttgattgcactctctccaggggagggaacaataaccccttactccttgagaccagtcaacatgtgtttgcccttgagatagctttccctagtgtctctggggagctaggaaacaacaggttagggtctttgtaattcttgcctctgccagggccttggccagagatctgggaggacaacagactcttcccctatgtgctgctagaaaactggttgtaatactgttttcttttctttctttcttaatttttttaagagacaggatctcactttgttgttcaggctgtagtgcagtggggcagttgtggcccactgcagcctcgaccccctgggctcaagtaatcttcccgcctcaggctcctgagaacctaggacaacaggtgctcactgccatgcctggcttttttttttttttttttttttttttttttaatttttggtagagacagggtctctttatgttgcccaggctggtcttgaattcctggcctcaagtgatccttctacttcagccttttaaagtgctgggattataggcatgagccaccaagcccagctgcttgtaacattcttgaaatgttgaccccactggagtgaccagcagagcttgccatgcctcccgatctgtactctttgctgtagtttagatatttgtccgcttcaaatctcatgttgaaatctgatccccagtgttggaagtcgggtttagtgggaggtgtttggatcataaggatggatccctcataaatagattaatgccctgccatggtgagagtagtgagtgagttctctattagttttcccaagagctggttttttaaaagagcccggtgcttccctctctctcttgcttcctctctcaccctgtgatttctgcacacactggctcctcttccccttttgccatgagtggaagcaacctccagcctttacctgatgtagatactggtgctgatttttgtacagcctatagaattgtgacctaaacaaacctccttttctttataaatcacccagactcagatattcctttatagtaacacaaacagattaagacacttcccacccagttgtctctcagacctcattacggttattcttcttacatgtgttccactttagctgcttgggtccccatgcttttctcaacacacaggctggtgctccttcttgcctttgcattgtcgtcccctctcctgggaacatgcctcctttagtgacctgaatggctcaccacttcacctcctgtaggtctttgctttggtgtcaccttctcagtgtggcattccctggccatcctatttgacactggccctacttctttccagagttctatctttcctgcttgattttcctctgttgtactcatccctacccacatactttgtattcctcttttttaatttgtttattgccttttttcctcctttagaccacaagctccatgaggacagaaattttgctctgctttatcccctgatctctccccagcacctagcacattgtacctggtgtataatacatttttttaagatctctccccagtacctagcacattgtacctggtgcataatacattttttttttttaagagacagggtcttgttctatcacccaggctagagtgcagtggcatgatcatagctcactgcagcctcaaactcctgggctcaagcaattctcctgccccaacctcctaagtagacgggaccacaagtgtgtgccaccatacctggctaattttttttttttttttttttgagatggagtctccgctctgttgcccaggctggagtgcagtggcatgatcttggctcactgcaagctccgcctcccgggttcatgccattctcctgcctcagcctcccgagtagctgggactacaagcgcccaccaccatgcccggctaatttttatatttttagtagagacggggtttcatcgtgttatacctggctaattttttaaaaccatctgtagatatggggtcttgccatgttgcccaggctggtctcctggcctcaagcaatcctcctgccctggcctcccaaagttctgaaattataggtgtgagccactgggcttgcctacaaatattttaaagagttaaattaaatatatatacatttcaaaacttttcctttttgtagaatatgtgccccaaacggccaatattcgaactgttttctcactatttttttgtagggtgagcttgctgatagccatatgtgctagccaatactggattttctgatgtctttattcatttaaaaattatcctttatggtgactttattactgagctctcctcttctgcttgtgtactgtgcagtctactatgggaggagtgagtccagttaaggtgcccttctttaaggggaggcctgctaagtggatcttctctagatagtgaggagaaccggtgagtgagcaatctagaccagaacacgtataatactggaggggtctttagcccagagatttacaaagaagaccaaaggatttatcagtaattaccctatctatgtaatacatgtagataaagatagataggcatgtatatgcatatatacagatacctatgtatatatctatctatatacatatatacatgtagatatatacatacctatatacatgtagaaatacagatgtagatataaatatatatatgtgtatagagatatgtgtagacatatatagatgtatacatatatagatagataggtctatatagaaaaccatctatctatatctagatagagatatgtattgatagatatctctccctatctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaaggcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacaccaaatggttcatcccaagagtcatcttaatttaaaaatcttcacatcttaagaagctacatgggaggctgcggcaggagaatggcttgaacccagcaggcaggggttgcagtgaagcgagatgataacattgtactccagcccaggtgacagtgtgagactctgtctcaaaaaaaaaaaaaaaaaaaaaggagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatacatgactcaatattccaataaaagtgctttttaaatttatattgagcattttatccttctttcttaaaaatcttaagctacacacattacatagctaggcaccgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctacatttacagagaattatatcaaggtgtctatttctaagacaagaataaaaattatgtttttttctaataatagaaatggataagcagaattctggcttctaataatgagaacatactatcccctagtttgaaataagttagataatttaactttctcatgttatcttgaagttaatacatcatttatattgaatatatcagtgcactacatgaagttgtacattgggtaccatcccttttatcttccacataaagtgatttagtgttttaatacacttctttccatatcctgcagttttgcatagcaaaagaagcatgcactttgaggaaaatgtaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcgaaggatgtaaagtatctgatactatgtccaaatatgatttttaagcaaatgttcctaacaatacataaataataacatggaataataaaataacatggaataaaataaattcatatagctttatgattaataattttacctaaattaaaaagtgttatgtgcaaatagatggtatacgacacttggcatgtaataatgcaattaagtccaattgaatatattgcttgatttatttccacaatctttgatacatgtattgtatatccaaacatcaaaaaccataagcagcctgtataatgccttttttattctctgtaaagtttttaatataaatatataaaagagcatcttaaattatttaaataagtcaattattttatatgtggatttggtattagaacatatatcttcttttgcacaataaacttttttaagtgtcagaaattatataattatatagtgacttttgttcacaaggtagttagttgtacgtacctacaagatacttgaaaaatatttttgccgagattggatgcatttttctcttatagactcttaaaaatgttaacaagccaacacatgaacgtactgaagtattttttaatcatcttttctagtgttgataatgagttggctgatataaagtcattagagtggcaattcaacaaatattttctatggcataacaaatgtcattaacttgctagtctgtcatgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaacatcacaccccagggcctgtcggggggtggggggcagggggagggatagcattaggagaaataactaatgtaaatgatgagttaatgggtgcagcaaaccaacatggcatgtgtataccaatgtaacaaacctgcatgttgtgcacatgtatcctagaacttaaagtatattaaaaaatatatatatttatttctactgaacacaatgtctatatattagatgacctagaactggtagggggttctaatccaggggattgttgataaactcagacaacttctataatttttacattgttactcttaaagtcttgtcattgattgtctcaatattggaaaataacatgtcaatattcagtgtaataaactggaagaaaaaatgggccaatatcccattcaattaaagacattaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaatatcatattgtagagtgcaatttaatcaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaataaatatgacttcataaaaacaaaaaattctatatttctaccctatatgcctcaaactaggaatagacatttccaaattatatctgataaagaatgtgtatccaaaatatgtaaactcaattataaggaaaattacagaccaacaataaacaataaggaaaagaatatacttgaacacatactttgccagaggaaattcagagacagcaaataatcacatcaaaagatgttcaatatctttagccattagagaaatacaaattaaatgagatgccattccacacctacatatactttgccagaggaaattcagagacagcaaataatcacatcgaaagatgttcaatatctttagccattagagaaatacaaattaaatgagatgccattccacacctactagaataaatacaattaaaaatactcatcatcttttgtgttggtgatgatttagaacaactgtaattctcaaatactgatggtaggaaagtaaaatgatacagccactctgggaaaaaaaaaatggactgtttcttacaaagttaaatagacccccatcattttacctacttattctactgttgctctttaagcagaaaacagtatagcatatatacatacaagaatgtgtttgcaagtggccatgacaaacttatttataataacactaaactgtaaacaacccaaagtttatcaatgggtgaataaataaaccaaacacggtatactcataacgtgagatataaccacacacacacacacacacacacacacacacacacacacacacacaaccatattttcaacaaacggtactggaacaattggacatccacatccaaaaaaaaagaatctagacactgtgtttacacaatgtacaagaatggataatagatttaaacataaaaatgtgagactatagaagaatgttataagttgaatttaataaaaattaaaacttctgctctaagaaagtcatagttaatatttaaaaaacaagccaagactgggagacaatatttacaaaacatgtatccaataaagaactggtatgagcactccacagaactcttaaaactcaaaaagaaaaaaaaaagataaataatccagttaaaaaatggacaggagatctgaacagacatttcaccgaggaaaatatattgatggcaaataagcgaatgaagtatgctcaacatcatgtattattagagaatcgctcattcgaacgagataccaccgcatgcctactaaaatggctaaaatccagaacactgaaaacactaaattgtgttgaagataaagagcaagggaaactctcatttattgcttgtgggaatgcaaaatggcacagccacgttagaagatagctttgcagtttcttacaaagttaaatgtagtcttaccacatggactagtaacttcactcctatccaaatgagtcaaaaaaacttcactcctatccaaatgagtcacatgactccttaaaatagcttttctcataacaaaacttggtagctaccagatgcccccaacaggtgagtaatggttcaataaactggcatacctataaaatgggatattcagtgatttaaaaataagctatcaaaccatacaaaacatgcaagaacctaaaatgcatacaacttagtgaaagaagctaatctgaaaaggctgtacactgtataattccaatgatacaacattcttaaaaaggggaaaactgtaaaaagatcagaatttccagtagtctccaagggaagggatgaataaatcaagcacagaaatttttaagaaagtaaaactattcttataatattgtagtagtggttacatgacatatgcatttgtccaaacgcatgaaatgtataatgtcaagagtgaaccctaatataaaactaatgtatggactttcatttataatatgtcaatattgatgcatcaattataacgaatgtaccacactaatccaagatattaatcataaagaatatggagagtagaagaaagtgtatggaaattctctctgctttgttagtttctactataaacgtaaaattgttctaaaaataaaatctattaattaaaaaaagaatgaactattgctaccagtatcaacataggcgaaagtcagagtagttatgttgagtgcaaaagacagacaaaaaagaatagattttgtgactccatttacataaaattctaccaagtgtaaaccattctgtagtatcagaaatagattagtagttgcatggagattgagtagggaagaggggaagaagcgattactaaagacacaaaataacttcagggaagtgaatatgttcatgatcttgattgccatggtgttttctcgtgtaccaatatgccaaaactttaaaaatacactggatatgttcagtttatgtcaattacacttcaatgaaaaacattttaaaatattatgtatcttgattttatgcttatgcagagatattatttctctgcataaaaaaggtatatatgcatatatgccatatataccttttggcatagtgtaaagatatataaacatagtatataaatatggtatttgtaatattcttattcatatgcaaaatatagtttacttttaattttttaacttttcttctgtttttattccgtatcctccagacattaacactgagaacttcatatacaattacatatttaaaaatgagtcatgtctagtataatacaaaatatcagcaatgtaacgtgacaggaacaaaatataaatgaagttgctttgtatagattcatttttctcattaaaacatttcatagcataatgcacttattcaaaagtattaacatatatatttaagtgcactatgaaaaacagaatcaagaaatggataccatattgatactaaatcctatgttaaagtatgttgaataattcgtagtttttcaaaagtaactcagtcatgtcacatattaataatgaatatatttatttttaggaactccttttaaataactattaggtatatagttttatgctgagttttatgagaaacacaataagcatatcattttatgtcaggaatagagagtatatttgtccctaggtcattttctatagctgtcaaaatgtttcaacatcttttagaactccagaaaatgaggaagaaatatagaaatgttcctaggttgttcttgtaactttatctagtttttttctattcttaattatattaattcttcccaatggcttatttaaaaatgggtcttcaattgtctttcattaaaattctatggggtctcattacgtgtaagaaggttttatttcacaccaagtatttttctgttatgtaaaaggaaaataaagctctgggctaaagaaataacttttttaaaaaattttccctattgggaagtagttgaatatatactttgctgttttcagctaaaacatattagaatgtgattctatttacaacaaaaatgaaataaggctgtgttacattggcaagctgtaatgggaaatgtatttgtcaccctaggcaaactgaaagggcagatatattgaattcagtaatgctgaataattaagccctcacttataacccttatattagagaattcaacttaataagttaagtcattttccaagtgtttgttaatgtatcaaaaggatttatacatttcacaaagggggactcaagctaagctaaagatttataaacacaaccaattcactagagaaataattttaaccgtgtttttcttgtttttccaaaccttactctttcatggaaaaaaataaaggcaatattataaaatagatgaaagtgcagggtaattaccttgcattgagaagcctagagctcacctgatccacaatatttgataatccatgtcacccctggtttacttccacagttcccttgaagattgaagagctgtctgaataccacagtcttagtatactatgttttgtaaggaaacctgcccactcaagaataccttctatgagagccaacccattcagcatgttaggaagtttgcttccatgtatgattcaagcccacctggtccagtggattggacaatgaatgaacgcttgatttaggtggaagttatccatttattggttggaaatcaataagcctctttcacttgagaattctaattgagatgaaggttataataatgatgcatactggatgcacaaagccatatagcctccataatgttataaagaataatattattgatccacaggcaagcaatggagatacaaagagtacaagagtaagaaaataaatgttgccctggagtgagagaaattgataaaaagccactgccttgatgttggacaggttcttagttctatgttcagcctttattttctgcccttggattctacactgtacatttcaagtttttttacaaaatggttttgactacagaaaaagcaagtgtgccattatcccatttttgacatattttgggagaaataaagtaaaaactatttttttaatatttatttatttatttatttatttatttatttatttatttattttttgagatggaatttcgctcttgttgcccaggctggagtgcaatggcgcaatattggctcactgcaacctccgtctcccgagttcaagcgattctcctgcctcaacctctcaagtagctgggagtacaggtgtgtgccaccacacccagctaatttttgtatttttaatagaggtggggtttcaccttgttggccaggctggtctcgaactccagatctcaggtgatccacccacctcggcctcccaaagtgcttggattacaggctccagccaccgcacccggccgtaaaaagcattaagagagtttttcagagtagtttctgagttacatgtaaaaacaagataaaaaaatttactaatagctctgcagctttcaaaattaagcagtcagatttctgtgtggctgagaattgctagcagtctcctccgttagaatttgccatgcccaaaatgtcccatgctatacagttaaatgattaatgtttgagtaatattcagtttgaaatttaaatttttcctcttgaggggaaaacatgcttagcctttcattataaaattatccaagctttcctctcatttctatgttcaaattcattgcatgagttaaagcatcttaaggcttccttctaaacaatttatatatttgccctacgatttcaactagtcctaatctcagaggatcacttcactggaaaagttgtgcaaaagtaaaacgaaatggagattaactatactaaattgtcatgttgagcttcgtgataaatttagttacaaagatattattcaaattggaattaactgcaaatctccccccaatgaaagtggagtgaaattggccgggtgcggtggctcacgcctgtaatcccagcactttgggaggccgaggcgggcggatcacaaggtcaggagatcgagaccatattggctaacacggtgaaaccccatctctactaaaaatacaaaaaattagccgggcgcggtggcgggtgcctgtagtcccagctactcaggaggctgaggcaggagaatggcgtgaacccaggaggcggagcttgcagtgagcccgagatcgcaccactgcactccagcctgggccacagagggagactccgtctcaaaaaaaaaaaaaaagaaagtggagtgaaattactatataaacctagagttatgaacatcagaaaacatgatatagcaataaagtaatttaatgttgacttagggagtcataaatcagatattttattcaacgaactctgatttttaattataacgtaagaattataaattagtatctaaaagtcattgtttcttaataaataatgagttgacaaaaataatagttgaaaaataaaattatataggatggttatattgtgaaaatttccattaaaaattaaaataataaaaaaatcgcctttggaaactacttttatttaaaatatcaggaatccagaaaattgcaacttttcttgatctacataatcatttttacatgaaattttaattccataaccattgcaaagatttttcttaataaacacagtattaagtatcaaacaccttctgtgaaagtacaatagaacacaaacatatactagagatattgttttctgcatttatgcatgaacaataagattttttaaatttttgacttatctgtggaaatatgatagagaattgtatggtatggtttaagtattattcatttctgcacttagatgaggtaattttttcttttctagataaactctaattccactttttccatacagtacacacatatacatgcatatatatgtttctgttaaacaacagtagtgagattttaacaaatgacttacctgtctttctgaaaagtgtcttgtctgttaatgtcatatgagcctgtaagggaagaaagggactatattacaaaggaacagaaatgatccaggagagtatgaatacaactggattctaagaatactgggctattgggtattgggatatagattgggataaaagagtatacccctatcagagcactgtcagtttcactactgatatggtacaaacacataacaggatggttcgtagcatcaaggaaaaagtgatggcctcaggtgaggttgcaatgtcaaatttcccatggaagatgacagaagatgcatatatcacaaagaaaataatatgtagaatagttaaaatctactctcaataatttttaagttattttaaattatatgctattgttattaactatagtcactatttccatagtcactacaactacaatcactatagatctattacataatgtacaatagatctctgaaacttatttctcctgtcaactgaaattttgtttcctttgaccaacattgagatagcaacttttatcacaatttaaaaattataataacataaaacaatgtaattttataacaaggaaaaggcatttcttgaaagttaattcacaaaattgaatgaatgaattgctaaacaaaacgatgtcaacaaccagaacaactctagatatctcaggcagaatgaattcaaagaaaacgactgcacatatttcttctcaacattagattcacaatggaatcacctggggcaatttttttttaaagaaacgaatgcctacatatcatgtccagactctgatttatttgttattaaatatggcctggacatcactctactcctgacgtccctgctcaagaatcaacttccgggaagagagactgggactcactgattttggtgctattcagttgaactatgcccttactgattttccacctgctggttctattcattattgatagagaggtgttaacacctccaattatcatagtggatttatctgtctgttcctgcagttctatctgttttcacctcatgtgttttgacagcctgttacatgcaaacacattaaggattgttacgttttcttggaaaattaaatcctttgttactatgtaatacccctttgtatccccctataattgttctttctctgaagtctttttgttggaaattaatatattaatccagctttcttttaattagtattatcatgttatatatttttcaaagttaattctcaagcttgtccacaatgtgcttccagaaattaatcaactgcatattaaagttttctactccattactaactcctgtgggggctcctgggcttttgctccactaggctataattctttgcattttcccatctctctaatttaatggggatttagggtgggcgcagcagtttttctgtgacctcagtcctctaatggatctaaaatgagttgttgatagtctgtttgtacagcatttttcttgttgtaaggatgggagtgatgactttcaagtttcttacatacttgaataactgacattttttattatatactcacccctgtggtggtagaagaatgctataaattttggatccacagaactaaagtactaggagagggaatttttcacaggaaagatggttgctacagaaaaaaaaagataaagtcttctctgctatctctgctagactctctaaactcttcctgtctctggagtccagacacccaagcctccttttagttttgagctttcactatgcttttatcttaaagactttgcctactatgtcttttctgctgagaaagcaccttatcccctcaattacctggttaacatcaaatatcaaatcatgcttctgactgaaggccaagtaccacctccagaagaaatcttccctaagaacagcctacatacagttaattgtgtgatcccttttcttatatccttcgaatactcttccttcacattactcttccttcacagcctttagccagacaacacattacaggaaaacagggagaacatgattttgccattcactcttacctttgcctagcccagtgcctggcaaatgatagattctcattatatatatatatatatttgaatgaattaataaatccaagtaaagtaattgatgttttggagttatctaaggctgttaaagtcagttaaatatagttaatgtgaagcaaaaaaccgtaaacaaaattaacgtaatatacacgctgatgttactattttagaaaaaaacacaataatttacaaattcctttcaataattcaattaatgtttatgagatttgattgaagacaaatccatcacggcaatctgtgaatgctttgttgtaaataaaaggtaatccttgtaataagcaaaaacaaattaacataacaaatgtcaatttacagatagacaaaaagtgattgttttctgaatgaaaagaggattattaacagttggcataagaaatcaaaaattagttcaacaattagtcatatggaaatgtcaaatattgacaatgtgataaagaaaacaagagtttctgcaaataacctcccatccctgatgtgagtctttcacgtcattctatagttcaactagttcttaataactcaaaaacaggaaagataaaatccatcattttgttttactacccagatccctcccgtagctgtcacacagagtgtgatttatgacttgtaagttgtgctatggagcttgacaagtaagtttgatttcatttaatattttctttaaaccatcttagatcttctctttgacaagtatttcatctattagtgttctcaaaatgtaaaatgggtaacttaatgagaacaaaaattgtacccaaagatatatttgcactatctacatatttgcaattaaatcttaacagatttaattgtaatagaatctaatggttttcctcttgaatttctttagacaccagaaatttttattactaataaataatgtttagcttcctagtcacaaaccaaacagaaagcaaatttcatcagagtttagaatggttaaaaccaacatagctgcaatatttttagttttgctttaaaattttgtttaatcaaacagtaaatcaatcagagttgatcattatgtaatccacagaccttgaaataacagagatatatttctccgcagatcaatatctatatatgtttttaagataagtagaaattcccctgaagatcataaagaaaaagtatgtcatataatatagttaaaaaaatagttattaattttttctgcttatgatgttccagaatctgtactaagcattttagaggattattttatttagttcccacaataatcccttgagaaatatactacaataatcatctttaattcacagttattgaaaatgagacacaaagaggttaagaattttgtccaaggtcaggcagctagcatgacttagcaagggtgtaattaagaaaaaatatgtttttcttatcttatgggaaatttggaaaagcaaatatctacattctctttttaataaaaaaaataaaatataaaatgtgagtctctcttaaagcagggaatcaactttaattaaattgaaacaatacataatcctttgttgttcaggttctgtattattattatctctgctgacagcaaaagctaagaatagaaaatatttctgacccaagttggcaaattatgaatcaacctgctaaagaatcagaataaactaacaagtggaattaaatatgattattctatattatatgtataatataaaaatttcttattgttataattttactaagattctaccagtttcaactaaattatcttttaaatccaagcttaataaaagaaattggcatgagatgttttcataggaaatagtgacaattcatattatttttaattaagtgcaaatgagatacattatttctgtatttcattttccttctaaaagtcatctttaaagttttagtttttctgaagttgacagctattactaactcttttgggccaagttttttgagatagattaatttataaaattaggaagaaactaaagtagttgcaaaagtttctaaaaagataataaagtagttgtctctatgttataatagaaaatgagaatgtgaatgcagatcattttgactgtttgtgttttcagcaaatattacctgaatattgatatataaattagaattccccaaaggaaaacattttaaaatgttaaaattaataaaatcattaacttacatacttgtccttagtatcaggacaatctccagtggattcaacagagcatctgcagttttgttgaacaaaggtttctgcaatatagacttatggtgtgagcttactgggtcacattctttgttccttcttggagctttgggaggcttttataaaagagctgctgcagtagaaggactgagttgtgtcacactgaggatttaagtttctatgggagaatcaaattcactttagtatagggatttagtgggtttccctagccttattaataaaatactaatacgacattaaaaatgcatactttgtcttacaataatccaattaagacactatttttgcatagcaaaattctttactaaacaccagttgcaaatcaagtgaaattgcattggcaagaggtgatcatactgctctcctactcctgccctttcctcctactccagctgaaaatacttggtgcaaatgtccttttataggagactttgaccccagggtatagaaaaggaaaggaaaaggtcacatatatatatgtcttgtctataactgaaacctaataccagcacaaaagcctaaaaggaccgatttttagagggcgttggcaggaaactctttgctctgctatcatctgttttaagctacttttatacatgatttattttttcagcttctactctgctactattcaactgcaaatgcaatttgttatattgtacacttcaacaccttgaacagcatcctaattattattgaaatgtattacgagttcgtaaagaaaacagcattttgtttcttcagtcatctacttaggatgaaagtgttatttagaaaacaataaatgggaaaaatgatacattaaaaataaaaattgctattaactttttagatcaaataaaccaattttaagcattttcatggacctttataaccaaaataaacatttaaatacagataatttaattcagtattttgtttcttgaaaatattggaatatgtgttttagataatgcatatatttctgttattgaaaaataagctttcaatagtcagctgacttcatacgtaaataataataccattttaaatttattcaaggatttaggtgttcttaaatatgactttataacttattttactcccttaaagtaaatatttatggcatctgtaagtcattgtaaaattgtaaaattggtatagcatagtattcagattgtcctttgtaatgttttatactattcacatttgtatttaatcacaaatttgatacaatttagccaaaccttcaacacatttatgaagagagcactaccgagactttatacaatggaataaaataacaaaatgtgctgacagcattcttccactcaaagaggtatatatatattttttattctaattctttaattttattttttagcacccaatgatagggaaaattactggaagtgtgattaaggctattataagatacataaactgtatggcataagcattctcaactcaacttcacactctacatcgttttatcaacttagtatgccagctttttaagtttggtggaatctggtattccacacctacatgtctctgaatcccatccgtgtactgatgccaagatgaactgaaccagggatgaatttttctcttatatggaaacatgaatatattccaaactggagtgagctctcatcagcggtttgcctatggtaattactttgtgccttgtaatgggtcatgtagtatcctcataagggtgcgtctgagtcctagaccctctcccattccagtacctgtaaatatcaccttattttgaaataggagctttacagatataataaagatctcagggtgagatcatcctgaatttagagtgagtcatgggtatttgggacacagaaacacaagcaaggtcatgtgaagatagagactaaggttggagttatgctgtcacaagccaaggagtgccaggagccaacagaatctagaagaggcaaggaaggattcttccctagagccgtcagagggtgtatggctctgcctccaccttgattttggtcttctggcctctataattgagaattttttttctttttttactattttaagccacaaattttgtagcaatttcttttggcagcactaggaaactagttaatacctctattgtttggttaaacaaagaacactattaagtatttttaaaacaatgtacatcagtgttgattatggtaagcatacagtttataatcagataggtttctgtgtaaaatttcatgttattatattgatttgttttaaccatacaagacttgcttggatgtggtaccattgaataccatccccattccctcctgtcccacagctttttgaaatgtatggggctttgttctagactgaacattccttttccctcaaatttcatatgttaaagccctaccccacaatgtgacagtattgggaagtgaggcctttgagaattaattaggtttagacaaagtcatgagcatagggccctcatcaacggaattagtgtccttataagaacaggaagagagtctatagagtgctctctctctctctctttctctctctatctgctatgtgaggatacagcaagcccggaagaggaccctcaccaggaaacaaatttgctagcaccttaatcttgcactttccagcttctacaattgtgagaaatgtctgttgtgtaagcaattcagtccatgatattttgttatagaagcctggactgactgataaaggctggaacatgctggagagatggtacaaaaactaattttagaaaaatattttaagttgtaagatctgaagcaaaaatcccttacatattaccatttacatcaccaaattactccatttacagtatcaaattaaggaaatttatgttttattcaagccttttaaaatcagcacacccaccttgcagaagtaattaataacccatgattattaattatgttggccaagttaattttcatccagtattacttgcagggaaagtttgaaattgatgaatcatctcccttttgagatgtcacttgtagaactaaaggctacctataatttctgtaattgttactctttaatggaactttaaacttctaagaaaaatatttcaatatattgttaaattgacttcaatgactaagattgtggtggagaggatatttccccaaactaactctttctctgacacttaggggttcattgtaatagtaacaccttgctagcaatcatctgctagtgatttgctcatggaagaagaaggctaaggaaatttaggtttgatgacctttttcagagtttctgggaaagcaaaaccttctctctactactcactgcaaacaagcatgttgtgcaagctactgctgccaaccaggtcacatccattagtgaagtcaatgctgtggagagagacattcaaacctgggtcactgatagtatcattttcaatttctgacccaatcaattctggggcttccaattcctctctccatggtcttatgtgaaataatacattttttaaactgttgaagtcatattgagctgaaatttcccttaattacaactcttaatattttaactatttatgctaagtttctttgttccagaaaaagtactttaactcggccgggcgcggtggctcacgcctgcaagcctgtaatctcagcactttgggaagccgagacgagcggatcacgaggtcaggagatcgagaccatcctggctaacacggtgaaaccgcgtctctactaaaaaaaaaaaaaattagctgggcgcggtggcgggtgcctgtagtcccagctactccggaggctgaggcaggagaatggagtgaacccaggaggcggagcttgcagtgagccgagatcgcgccattgcactccagcctgagcgacagagcgagactgttcaaaaaaaaaaaaaaaaagtactttaactcattttcatttttgtaggacttgaattttttagggcagtttcagtttcacagaaaaattaagaggaagacatagagatttaccatatatatgtagtaatatatattatatatggtaatataccatatattactatatatatatatatatatatatatataacaagcatgtggaggcagggtatattatatatatacacacacacacacacacacacacacaccctgacataatatatatatatatatacacacacacacacacacacaacccctgacataatgtgtatatataatatatgttatatattatattatatatgtaacatatcctgcctccacatgcatggcctccttcattatcaatatcttcctccagagtggtacgactgttaaaattgcctcgcctacactaatacaattttattgcccagtggtaaatatacataacataaaaggtaccatttaatcattttcaattctaaaactcagtgatattgaatacattcacaatgttgtataattaacactgttttcataacttttctatcacatcaaacagaagttctgtaccattaagcactaattctccattccccttgccccagcctccatgccctggaaacatgcaatctgcattcccactgcatgaatttgactattcatgatctttcatataagtagaatcatatactgtttgtccttttgtgtctggcttattttatttagcataatattttcaaggtttacccatgttgtaaacatgtatcagaacatcattccctttttatggctaaataatcttcccttgtatgtacatgccacattttgtttatctacacatacaggtttgttttcactttttgactcttgtgaataagaatgagtgatggtatctggtgtgtgcatacagccattttcttactaaaggccaacagcatcaagcagtctactaatggttgttatttatctgattaggatccagagttccaaaaaggttaattcttattttttccagtttaatggcagtttttgtggagggattgacttctataacttcctattccaatcttctaaaatccactttaaaagaatggtttaaattgtgtgcttgtaagatgaaattgataaacaattattttaataactttcaaaattacatcatagagataatgtcctttgactattgggtgttcatatatttggcatgttatgaacaaccttctggaagataaaggccttttatctcatacttaatattaagacaggaaccagtgtgctagcaatggcttttgggtttgatgtgatatatttgcatgtaatgattttttaaaacttagagagaaaaatcctctcatacaaaacaaaatagtttttactgttatgagaaagtagttattaattacttataaaacatgcaagtatctttatgatatttggtgacttatttttctccagccatcttgtcttgttgttagtggggaaaaaaatggggatgctctttatctatgaaaatgtgaaaagtatatacacattttaactatacatggtttccctaaaaattcttcttctgtttttaatcctctaaaatgatcattgatatgtacaaataaatattgatgatagcaactgaaggatcatttttgctgttatcagaaattgaaaatactgtaacagtctatcaatagagaaatggttatgtacattatgatacatagcatatgtccatatttagaatacgtaccaaatgtatacaacaaagtacaatgaatacatgattatactaagatggataggcatggatccacatattactctgtttgtacatggtcttttccaaacagaaatacaatgtaagaaagaagaaaagaaaaataaagagaaagagaataaaggcgacaaaataaaatataaaccaggatgcataagctggtctcaccttagggctggaacaccagtaaagcttctcttctctggaaaaagcttaggtctctgaagttttctcagtgcatcaaaactgacagcagcaggaatatggttttgctaaaggcaacagaagagcaaaacagtctcaagatttaaatattaatccaaaggttaaactttttaccttaatgttgctactttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtaccacattctattgtagacactgcggatatagcagtgaaaaaaagaaaataaagaaaaatatgcctttttggagcttacattctcttggaaggagatgtgtaacaacataaataattaaactatataatatgttaagtgttgctaagtgctatggaggaaagtaaagcagacaaagcaaataaagaacatgaggaggagatataattttaagtagggaaataaggaaggcatgacggagacagtagcatttgagtgaaagacttgaagaaggtgatatggtttgactgggtcccccactaaatctaaagcttgaatggtagttcccataatccccacatatcatgggagggacctggtgggagacaattgaatcatgggggcagttacccccacgctgctgttcttgtgatatgaatgaattctcatgttctctgagggttttatcagggttttttcccccattttgcttggcacttctccttgctgccaccacgtgaagaaggatgtgttgcttccccttccaccatggttgtaagtttcctgaggtctcaccagctgtgcagaactgtgactcaattaaatctctttcctttataaattacccagtctaggatatatttttattaacagcatgagaaggaactaatccaggagataaggaaacaattcagggaggaatttgaagacaggtgttttcagtcagagaaaccatgtacaaagtatctaatatgagagtgctatggtctgaatgttgacaacccccccccccattactgttgaaatgtaattcacagtatgatactattaaaagttaaggtctttggaaggtgattatgtcatgaatacagagccttcatgaaggagattggtgcctttataaaggatgcctgagggggctggtttgtcccttccaccatatgacgactccaccatgtgaagaagaagatgggtctatgaactaggaaatagggcctcatcatatatggaatatgtgagcactttgatctgggacttagcttccagaactgtgaaaaataaatttctgtcatttataagctacttagtctatggtattttgttatagctgctcgaatgggctaacacagagacaattcccagcctgcccaaatagcaccaggaagtgttgggtacagcaaacctggaacagaggcatgaggggaagagcaacagggctgtgatcaaagaggtgtgcctggtggggagcatgagtagagctatataatctgtacaataatgactcagagtggaattagaagtccttaaaagtgagtgagcagagtggcatgatctccatgatactatgttatattcttgcttgggtattgagaaaagactgaaggtgagggctaatgcagaagcaggaagggggataaaaattcagatgagacatgattttggcttggcctgggtggataacagcagtagtaaaaattatttaaatgttttgaaggtgggtttgctgagaagtaaaggatgtgtggagaaaactggattgagaattgtataaggactgtattgtatattgtatgagagtgtagatccaggatgagtcacagtatttttgaagttgtagtaaatggaatgaactagaaagatagaagttaatgttcagaaggcaggagacttaaaagttagattgtaaaaatttgcaattaggagtaataacgtggtttgagctgagatcatgagattgaatagctagatactgaagatagcaagtacattggaaatgacgaggtcaaatgtcaaagaagataagtaatttaaatgagacatcaaaataatggcagtaagtcaggttgtaaagacttcaaagaatgagggaaagtgactaaacattgggagagtgatcaatataatcaaatggtatgagattccaagctggaggggtttgaggagaaggaagtagaagtattctgcaagaggacacttattttacttctagaggcagtggttagagcgctgagggtgagaactagtctgcacttagggggagacatgagaagcagcagcatcagtgagagacagatgacaataagaatgaaaatgtaaagggaaaattgagaaacttataaaaattgagattcttctatgcactctgtacgtttcttacagaagctttcaacgcatttaatttcatttaaatcttgcaatactcttgagagatattatcattccctttttaccaaaaaaaggctgaatggccaagatcacataaaatcacataagtaatagaagtcaaaagtatgactttaacccatctagtgttataagaaccacataatcttcaataagttgaaagtatcttaattaaattaaaaaaattaataaaatttttttcaaaagatgtattcaagttatcaatgtgaagaaaaatgaacatattacttagaaacagccctggattagagtcccaattatatcacttaataattgtgtggtttaggtaagccatgtaaagttgctgtactacttaaatttaaaataaagacaattttacctaaacataaaattgttgtaatgttattgtgcagttataaatcacttattaaattataaatttatgataagtattaaacagaatacttaattttaagccataaggtcttctattagaaaaatactctaatataatgtgatacatcactcatttttataaatataaatttaattatagccttaataaaaaattttggaggtgcattaccaaggctaaatttatatttcataaaatgaacaaatttaagatgtgtaccttaactttatgtatttctgcactcatattcacaccagccatatcaagataaagaagtttcactaccacagaaaatgttgtgctgctttattccagtcgataaccactggtcaaatttgtctggaatcatatagattttatgcttttgtgtctgacctattttactcaacatgatattttggagatttatctatgctgttttatgtgtcaatattttattttgtattgctatgtattattactctgtaagtcaatatcataatttatctcttctccactttatagatgttacatccagtttttgcctacaaaaaaaacctgctgtgaataattttatatcggtctctattgtgtgaatacacaccctcatttatttttggtacatacctataaattgaatcacgatgtcactgggtatgtgtgcaggttaactttataagaaattgccaaacttctttaaaatatagctgtaaatttactctcccaccacaaatgtatgagattttctttgcttcataacctcttcaacacttgctatattcagtccccaattttctttcttaagagatggagtcttgctctatcacacaggctggagtagagtggcacaatcatagctcactgcagccttggactcctgggctcgagctatcctcccatatcggtctccaggtatttagccattttaattttaccagttctcttggatatgtaatgacatctcactgaggtttttattttcattttttctgatgaccaactatgtcatcaggagtgaaatcactgagtcataaagtcattgcctgttaaactgtttgtttgctttttaaagaaagtatcaaattgttagagaatggctttgttattttacattcccatcaaccgtgcagcagttaagtagtttctttgcagccttgctagcactcagtgttgtcattattttttattgtaactattccattgggtatatattgaaatcccattggggttttaatttttcattccctaatggctaatgatgttgacgtcttttcatgctctgattttccaaacatatattcttttcagtgaaatgtatattcatgtcttttgcccactttctaatttgactttgttcactcttaagttttgaaagttctttatatattcttgctactagtctttttcagacacatggcaagcaaaaggggaaggaaggagcacctttttactgtcaagttgagatgaaggtcaaggttccccattaggcctcctttgccacacaaaaagtaaatactctgtgtttttaagataaagtaatggatgccaagaaagactcaaattttttttatgtactaatcataaaaatgaactatgatttataattcttctcgtccattttcattatacataagttaagaaaacaaaatacatcatactcaataataagaattctgagtagaaactcaccagttcaccttagctatattttcccttttgggtttcttttacttttttttctctctctcctttttctttaaaaattttggagtgtgcagagggataagggtgagggagcgtggcaaggagaggagttcagatcaggacagggaatggaggagggcaaggagtgaagggcacaacccacagcctgggaaagagaggcatgaaacccagcgtgtcaggtggacggatcatggaatggggggccagcggaggttaaggaaggagggcccaaaggtaggggtgggaaaaagagaagaggaggaggaggaagtgcgcgtgtgaagagtgttaagaaaacgacaggacagagcggggaggggaaaagcgggccgagggacagggtgaaaggtgagaaaggagggtatgaggaaagagggtccggggcgctggggatttggggagacgatggagcgacgggtagagcagcttgggccgagccgcgggggtggaatccagacgccgggcgggggagggggcggcggggcggcgggacggtgggtgggggccaccaggcggcgccggagaccaccaaacattacagcgagcgagcctgcttcctggagggagtgcagacaaggaccaggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatg

SEQ ID NO: 2198 - DNA, 9530 bp, Homo sapiens
aggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacgagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctcggggcattggagctggtcctgcagctcacacgtaaagaggctgctggatggacgggaggtcacgctgttcaggggagcttgcagggcggttgtgagggtgatgggctgcactatgggaaggtatatttttgaccatattaatctggctgcggctcaggacagactgtcaggggcctcatctcaactgcccgtcactgtcccgtgagtccagccaatccttactttcaataattttcacaacaatgtttacagaagacccaggtcagagagggttcctggtgtgacgtgagctacggtttgggtttaggtctttgagtacacgccccagtgcctcccctttaacccagtattgatggccaggagcacctcacatggggccggggggaggagctgcaggacccagcaggaacctgacacatgcccgcagttccgctgaggtccagttagcacagcggtggtggagcctgcacagggggatggtcttgggccctgcactggggccgatgccgagcaggtatttgcatcttcaccctcaatccctcctagaaaaagggacaatgatgcttcattcagaggatggtgaagagataacttgagctcacatatgacatgcatagcacagtgcctggcacatgctatgacacattacatgacagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagatcgggtgtctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacattggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggcgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccatggatttgagtatctgtgtatgtgattgtgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccctgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaa

SEQ ID NO: 2199 - DNA, 1165 bp, Homo sapiens
cggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctaga

SEQ ID NO: 2200 - DNA, 12977 bp, Homo sapiens
aggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctgggggcattggagctggtcctgcagctcacacgtaaagaggctgctggatggacgggaggtcacgctgttcaggggagcttgcagggcggttgtgagggtgatgggctgcactatgggaaggtacattttcaacaatattaatctggctgcggctcaggacagactgtcaggggcctcatctcaactgcccgtcactgtctcgtgagtccagccaatccttactttcaataattttcacaacaatgtttacagaagacccaggtcagagagggttcctggtgtgacgtgagctacggtttgggtttaggtctttgagtacacaccccagtgcctcccctttaacccagtattgatggccaggagcacctcacatggggccgggggaaggagctgcagggcccagcaggaacctggcacatgcccgcagttccgctgaggtccagttagcacagcggtggtggagcctgcacagggggatggtcttgggtcctgcactggggccgatgccgggcaggtatttgcatcttcaccctcaatccctcctagaaaaagggacaatgatgcttcattcagaggatggtgaagagataacttgagctcacatatgacatgcatagcacagtgcctggcacatgctatgacacattacatgatagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagattgggtatctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacactggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggtgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccaaggatttgagtgtctgtgtatgtgattgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttggaaaatgctcttggggctgctgcctctgtcctcggtgctgtgctgctccgtggagggtgtctgtgagggagggcagaggaactggcagatgccaggctctgggaacccacagaggccggccccactctttcctcctgacgtagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaag

SEQ ID NO: 2201 - DNA, 11128 bp, Homo sapiens
agtaatttcacaccactttattgtggaatcaaagacagaattcttacagaggtcttggttagttaagaaaacatccattcaaagatttgattcacaggacaccctcactgtctttctctttttttttttttttttttttttgagacagggtctcacttcgttgcccaggctggaatgcagtggtgtgatctcagctcactgcaacctctgcctcccaggctcaagagattctcccacctcagcctccaagtagctgggattacagccatgcactgccacccctggttaatttttgtatattttttagagacggggttttgtcatggtgcccaggttggtcttgaactcctgggctcaagcaatccacctgcctcagccacccaaagtactgggattacaggcgtgagtcaccacacctggcccttgcttactttcgtacttcccatgaggcaggttaccaaattggtgaaattaaccataacgtcattgtggtgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttgcttgtctttatcattctttaaggagggacccagacacagtgtgcagaggcctgaatcctccagaccattctctctccaccatgagtcctgccgtggggacctttccggctccctttggccttatgagccagaaaatcaggctagagcctaaagagaacagaaatttcataatcaggcctgttctgtgactgtatgggggagctgaaggacacaatgggctttctatattggagactacccatcatactctctctgaccagggagaaaggacagatgctgtgtgattttgcagtctgtgatttggcttcttattctcgctgctctctacacctcattatttacttcactcccctgaaaaaaatgctccctaacaggctcagtacccaacttctgggtattgctgcccacatttgccttggttctaccttttcagattgcaggatcctgaggttttgcttggagcaactcagattctccactagatctaagatctcacctagtcctgaggatttccttaaagggaaggggaaattagatagatagatagatagatagatagatagatagatagatagacagacagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagaacctgcaggatacacccatgttccaccacctgcccgaagaagcctgtggttcttgtcagcttctcaagggtgaagcgcagatcattttctgcttgagcagaagagcagaccaaagagctcattgactcaaggagcatcacggcaactgagctgcacctggaagagaagaatccagggtgtgatccatagccaaggcctgaagcaatggggcccatacttggcctctccagggtgagttgtgacccaagtgctgggctttagcccatgagtggtccctcttgccattttgtttcctcccaaagagaagccagtgttggtgatttcatttctcataatctccttaggagcacaggttttggtttgtgccttttttggatcaggttccctgcattgcagctgctataattaaaactattaacaacaacacagcaccacagaagcaagttagttgctaatggaatttgctgataatgctatcttctagagaccactctagtaactggagagccttggtgtagagctgatgataaaacctgttcctgcttttgtcagccatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtagtgactcctcatcaaatggaggaatgtgccagtattttcggcaaaacatgaatctgatgaaacactgactgaactgtctcctagtttcaaaacaaattattaccacttagggcctctatttagggcaatcagagtcagaagtgggaacgcatcttgtcctcctaccttgattaacagtaactctagttgcaggatgatggtcaaatcctctctcctctaatgtgcagttgtgaaggatttaggctccactgctcctgcatttgggtggggcctgaatcactttcagtctagcacaggcgggtcacttcaggccttcccacctccatcagcatccttcaatcctcccctgacatctctcatttatgcttcctattgattcagagatcccatcccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcacccaggctggagtgcagtggcatgatctcagctcactgcaagctccacctcctgggttcatgacattctcctgcctcagcctcccaagtagctgggactacaggcacctgccaccatgcccggctaattttttgtattttgtttagtagagacggggtttcactgtgttagccaggatgatctcgatctcctgacctcatgatccgcccacctcggcctcccaaagtgctgggattacaggcgtaagctaccatgcccagccaagtattctattcttaatgaacacatatatgcataatatatctattttttataatatatatatttagaattgaatgtcagagtacatatcagtgttggaggaagggaataaggaggaagcacagaaagtaaaaaggaaaaataggcaccaaaaaagatttggagaatggcagatggccaaggagatgcagctgggaagtgcctcttccatggagaggaacataatatctagtaaaccttcacattttaaacagatcttttgagagaaaacactgaaagttgacacagaggtgacacagacaccatggttgaagagggaagaaatggggcagtctgctcagagtcactagacaccaggactggcccatataccctgaacaaacccaaggaaggggtgagtgaagaaaccctgggacactacatacccataatgtatctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagtctccatttcatactgagtggctaagttcctgctgtctgccaggctgggagtgaaccacgcctggccggctcacatgcccaagataggccccatcaccaatgctgtgtgattaagttgcatctggtccacatgcccccttgcctgtcaaccccttcccagacctcatgcctggtcacgcctgcaagagggtgtccacagcacagcatccactgcatagcttgagtgttttgttgacagcctgggaaaagctcaccaccctgtccccaaatcacagccagtgcttgaagcttagaggccagaggacaaatccgtgagcccagtcccaactccccaagactcaagtataccacccagggacattgagctgagatttgtaacctaatctcaagtgaaggaggatcctccatagtcagaatgcagagaagggtgtggtatgggttctcatgggggcatgggagctggacgcccctccctttgcaagaccagaccatgaagggtatggcctgatggtggtagcttctttcccagggagtgtccttgcacagaatgcctggagcagctcaacaatgtgggagcagatagcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaggggaagggggagtgcagcctgccaaagcacaacatgagacaaagaaaatgcgaccatggcataagccactgaaaggagcaccaccaaggcccagaaccagacttggagaaggaattatgtctcacctccatctcccctccccagtgcactgttgcagatgcaaaaatagctcttcccataggggcccagaaagcatgcactgaaagaagttgtttctcatgattctccagtgagggcaagcatgcaccaagaccccacctgccagctcttactcttaagtccatctaccagattgaagtttgagttataccatcatataaaaatacattgctaaaacaagcaacatctgtgaaagccactgcagcaacctatctgtaaccaaggaacatatatggaaacttcaccgtctgcaactacccagaaatgaagccaatcaatcacatacaccacagtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcatggctaggacaaagcaggcaggagaaggcagaagagcagacttgctgagtctcctggctttcatctttatcctgtgctggatgcttccagttcttcagcttttggactcttggacttacaccagtggtttgccaggggctctcgggccttcagccacagactgaaggctgcactgtcagcttccctacttttgaggttttgggactcgaactggcttccctgctcctcagcttgcagatggcttattgtgggactttaccttgtgatcatgtgagtcaatgatccttaataaactccccttcaaatgtacatctatcctattacttcggtacctatagagaactctgactaatacaaaccccatctaaatgaatcaaattcaaaaaagaagtgtcaactcccgcagatggaaaggaataagcacaagaagtctggcaatacacagagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaagttctggaactgaaaaattcactaaataaatttcaaaatatagttgggagacttaaaaacagactaggccaagcagaaggaaacatttcaaagcttgaagactgattcttcaaattaacccagtcatgcaaaaataaagaaaaaatattttttaaaaagacaaagccttcaagaaatatgggatcatgtaaagaaaccaattctaccacgtattggtattcctgagaggaaagaaagagtaaccaacttggaaaacatatctgaggaaaaaattcaagaaaatattctcaattttgctagagatgttgacatgcatacaccagaaatccagagaacccctgttatatactataaagacagccatccccaagacacatagtcgttagactatctaaagttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccaccagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccacttaaaagacatagagtggcaaattggaataaaaaaatcagaatcacccatctgctgtcttcaagagacccatctcacaagtaatgacactcatgggttcaaagtaaagggatagagaaagattaatcatgcaaatggaaaacaaaaaagagcaggagtttctattctcatgtcagagaaaacagatcttcagccaaaaacagaaacaaggacaaaaaaagttattgcataatgacaaagggctcaattcaataagaataattaactatcttaaataaatatgcacccaacattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatacatatatatttcccatcttcacatggaacatactctaagagtgatcacatatgcagttataaagcaagtgtcaagaaataaaaaaaatcagataatatcaagcatcttcttggaccgcagtagaataaaaatagaaatcaatagcaagaggaactctaaaacacagacacgcacacacaaacacacacggaaactaaagaaattactcttgaatgacttttgtttgggtaaacaataaaattaaagcagaaatccaagaattttttaaacaaatgaaaatagagacacaatgaacaaaaacctctgggatgcaataatggcagtttaaaaaggaaagattatagtgctaaatacctacatcaaaaagatagaaatatctcaaattaacaacctaacattgcacctaaagcaagtagtaaaacaagaaaaaaaactatatccaaatatagcataagaaaagaaataacaaaaataagaacaggactgaataaaattgagactcaaaaatccacacaaaggatcaacaaaatgaaaagttggttctttgaaagtgtaaacaaaattgatagactgcaagcaagattaacaaaaaagatccaaataagcacaatcagccataacaaaggcgacattcactcgagtcccacagagattcaaaagattctcagagactactatgaacatttctatgtgcacaactagataatctagaagaaatgaatacattcctggaaacacacaacctcccaagattgaaccaggaagaacctgaaacactgaacagaccaacaatgaattacagaatgaattgaataagtaatagaagcctgggactagatgaattcatagctgaattctaccagacacacaaaggggagctcatgccaatcctactgaaactattccaaaaaatcgaggacgagagattctcctctgacttactctacaaaacctatatcatcatgataccaaaatatggcaaatactcacacaaaaaacaaaaccctaggccaatatatctgatgaacatagttgaaaaaaatcctcaacaaagtacttgcaaaccacattcagcagcacatcaaaaagataatacaatatcaagtgaactttattcctgggatgtaagggttgttcaaatatatacaaatcagttaatgtgattcaccacataaacagaatttaaaatgaaaaaaaaaaacataagattatctccacagatgcaggtaaaacatttgataaactccaacatgccttcataattaaaaccctcaatagactaggcattcaaagaacatacctaaaataataagaaccatctattgacaaacctagtctacattatactaaacaggcaaaagttggaagaattcccataagaacaagaacaatacaagaatatccactttcaccattcttattcaacttagtactggaagccctagccagaatgatcagacaaaagcaagaaacaaaaggaatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcagtgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacgaggctacaataaccaaaatagcatggtttgggtacaaaaatagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcggaagaatgaaattagactcctgtctctcaccatataaaaaaattaactcaagattgattaaagacttaaatgtaaaactttaaactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggcctccaaaacaggggaaggaaggagggcaaggtttgaaaagctacttattgggtactatgtttactattcagataataagttcaatagaagcccaaacctcagcatcatgcaatatgttcatgtaacaaatgtacacatgcatgcttaatctaaaataaaaattaaataatcaaataaaatgatttccatgaataaaatggtagatatgattatgtggaaaatgctttactatttattatgtggtgaataatttaataatatttaataaatacatgaatgaaaaatagctacaactgtgtgttaggatttcaataattttttatttcattcctaataacttttatgtattattatatacataataatatatatagttaataataacaaaaacaacatggtattgaaataatttccacccagacggaggatcaacatatttaagtgattacactactcaagataaaaatcatttatcaaacagatcaaagtcatttacctgctttcctttttataggtcctaggaacacacgtgccacagacaataaaacatcacttcccccatcccactactttggactttatttaacatctttgggtagaacagaaactgttgataaggtgagttttgttttatagacaagagaggaaaatggatactttgtgtggtctgggccttagaaacagactaagatctttttttttctattttgctttttttactaggataaaatattaattggcaaaacatcgaatacaagcttcactatcataaaatcaaaacatttaagcaatattccaaaaaagatttgacaaaaactagacaccaagagtacaaaaattacacatcaacacaaagcataaaaaatgtgaactttcaaattaaacagtcaaaaacatgtacctgcatgatcacctccacaccttgactgccttcgtctgcagcacgctgctggtaaaggctgggtggctgcaccgtcgtcccctaacctaacattgctttcatctgtgaaaattcgcttgatagccaattaagccatggaggctattacatttacacggaggctacgcacaatctcaggggaggctcaaacagcagttc

SEQ ID NO: 2202 - DNA, 1135 bp, Homo sapiens
acctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaa

SEQ ID NO: 2203 - DNA, 8759 bp, Homo sapiens
attactttatccatgtaagatttattaaacatgtaacttcgttggaaccaacaaagctactttcatgtttttatgttgttctttttagatatttagattaaccagataatcttaaattatcttagaaattagaaagtttctgcagtattgttacatttgttccaagtatacaagttgtttctatgcactaccttctcaatcctgtgaaagaagtctattaccaaagcaatttctaacacattgctcaaaagacacagtaacgttgtgaaaggcattttgttggatttagtcccattttagtatccccttaaaaagtttgactgatgactctggatattcagccaacagtgttgtgtcaaaaacttgcttgaatttatctaaaaattcatagtcggtgctgaacctgaatttgtttgcccaaagcagcaccgtccctggctgggaaaggtacaccatggtggtgagcagcttgtccaggaagtagtgatggtagaccacatctgaggctaggacgtaatcatagtaaaaagctgacttgggaaagtttttgtccaggtcttccccccataccagttctttcacttcaggcagatgtgctgtacattgtagtgtgttttttaaaagattgtattgaaggtttcccaggacatcaggcaaatctgttgctgtgacttgagctcctaagagaaaaagaaaacaatgacctggaaacatctgggcagtcacagtgtacatatacccagggagaaacacaagaaacaactggattccttagccttggctctattggtgggtgggctggacatgtttgacctaatgtgggctggctaattcttgtgggtggtccgtcccgtgcactgtaagatggtgagcagcctccctggcctccaaccacctgatgtcagtagctcccccacctcacctcacctgtgggattgacaacagagattcagagtcatgcctctggactcaacttcgtcccatggaaactggttgattggagtttattaacctctctgagactcaatgatctctgtagataacagcagtaattcctgccgcatgacattttggggagagtcactgagtgaagttagggccaggcacctaaaccacagcctgtcatagagtaagcacttgctattgttgttacagtaaagatctggatactaggtcaggaataaacaaacaaacctaaaatactggccacaatggaaacaaggcctggtccggcaccaatttcaagtatttttgcatcttggaaattcaattcctcggcatgttcctccaagtattgacacaaagccatagcctaaaaaataattataacttttcatgtgggcattggaacattggaaaccagtagcaaccctttctggcacccaaatttaaatactaaaagacatgttattacatatgttcagtttatattcataagaacccaaatgtacactcaatgccatatttagacctctgaaataaagaagttataataaattgcatctcaggaactggggaaaaagatttgttaaattgcctcctaaatctccaaagaataggaagaacagtagatcagcttagctctttcaaatcagggcaatgttgggctaaaagaacagcaactccttccactggtttaatcatgttggtctccaactgctttaggaatgttgttttatgttagaattctttcttgtaagagagttttttaaattatagaagtaattttttaaaatgtcaatttataaacttgaacacctctttcctgactcctttaccaaaattcaggttggcgagcactttgccgtattgagcgacgggttagtgactttttttaaagtggttcttctaagaaacagacagttcagaaactgcttctcagacttcagtgtgcaaacagattccctggatagcttgttaaagatgcagatcctcattcagtaggtcgagagtggggctcaagatcctgcacgtctaaacaagccctgacatgatgctcatctgctggcccatgtacccactttgagtagtagcaagcagatttttttaaatgttttatatatcaacaaatattgttagttttttatacaggaaatcaaacttccctttcttctttattcgttctcttctccctccaccttcctctaacctttccacaaagagtaaagggtatttgatttgcattgattgctgaggtgtttacgtgtatggcaatgaggcatcaactagcagtgcccttgattggagagattaggaagagttatgagaagaaatgacaaaaagttacttaaatttgagtataaatagcccagcgtgaggaacgtgaacactgagatttaaaaaacaatgaactctataatttacttatacatttaggccctagctaaagatatgcccccatcttcctctggactctactttctatttggggcccagtttggagtgggggcagccaggatgattggagacgtgtcactcttaggattaccagtggtaggtttggtagccaacctgaccctgtacgtcactccatttcatcctcatctgttcatattgaactgccacgggcaaagatgaatatgacgcagtcacctctactgtctgggaactcagtggtggggcttaggggccatgtcagccaattacaaactgaattctggggaggtaagtgctgtagaggaggcagacagctggttgaagggagaggggtcaccacagagccgccgaggagtctgggccgacttcatggggccggggagaagccagctggtgtggaaggccagggcggtgggtaaaatagcaacatggtgtgacataaatagcaccaactgcagcacgctgcagggagctccagagcttagaagggaagttttgaagaaaggagttctttggtccttaaggagagaagagaagtatttgctgtgggggctgggaggagggggtcaatgtcaggaaaagagtgtcacctagagccattcagagggcagctctgaggaacttcctggagatggctgcaggggtccttcctggtgccctgccctgtgaggggctggccgcagggtgtcatgcggagacaaagcttttctcagggacagctgtgtcttttgacattgcaaacattcccccgccagccccttgtcctgttagcaaactctgaagagatcttttcacagagttgcacctgaagtcgcacaggaaaagggcgccttcccactctagatgcccttcttgtgcagctttcaggaagcaggtttcatgagaggctagtgtttggtgcatgagtgataccttgttcagaataaaacagggggacaaatattcttttttcaatttctgatcttttttttaaaattattatttttaaaagggagatggggtctcactatgttgcccaggctggtctcaaactcctgagctcaagcgatcctcttgcctcggcttctgaaagtgctgggattacaggcataagccacatgcccggcctctgatctcttactataccactttctcgctacaccactgctgtcgtctatttgctgaatgtgttacaataggaagctgtgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttcttcagagtgttgttttagcctgtgactttgatttagtatgttctaccactttgaaggagaattctctgccctgacaaaaaaggtgagcttccagaaacctgggacctcagtgaacttgcaagacgcctctaataaaggtaaccaattcagtcctgagaccttgtcctttgcggtcacctgccctggtaggaggctgtagggagattgtagggaaaggagggagccctgtagctttccccacctcttttgggaagccactgacatctagcagaaccccagctcccaacacagggctgagaggctggctctgaattctggtttagaggcaggaggaaggccgaaaaatagggtgattaatgtttaataactagttcagcaagaggggaagaagcggtgattgacagcgtttgacgattgctctggagtaaatactcccaccgtgccgttttcagagaagcagcatgacttcgctggggaaagacgtgcagtacctcgccactgtgtagtgttcctaccgtacagacaccacagacacgattaacctcgagagcatagatattaggaagaggtaatagaataattgatgatgagttttgagtgtttatcaactttgcttttaatatacctttgtctttaatataatctatttaatcataagattctaacttaaatttaaatgatggttatatataacaatcagctacaaaaaatgctgaaattcaggtgccagtacaagccgtcgccagcacaccactgggtggtggctcagagcatcagggacctgtaccagcccctgccggcttccctgccctgccccactctcatccaggccatgcctgtccctccttccaaatgtcaccatctggggacttatttttctctagagactaggaagagtaagtaggctgattttgaatggctcatcatttcacaggtaaataaactgacaaatattaagcttgacagctgcacttttccaatcaacattgtaaggaaacatagacatacacgtattctctcataagaccctgtgaggttctacaacgataaagaaacatatgtttttgtgcctgaaatattttcatttattctctgtgctattctgatagttttagagagatcagattttcagataaggtagagttgcatttttacgtaaacaatgcagtaaaaatagacaacattctcatttattggagttgggatacattttttaccacctttaattatgaacactgtaaatgctgcatcttggcttttattagatcatttgttatgtctattatttatttacaactgaatccatgcccagaaatgtaaccctaaactgttacattgtcctaacggggaaatacagtttgatttataaagattcactgtatgacaaagctaccaagaatgtattttggtgaaaagcagaaatgaacctagattttttgttcttcttttaagttcttgttacaaaaatacagcaagcttagatctatacatagaaaaaaaacaaatgtgcaaactttgataagtaatgaaaaaccaggaattacttttaataagtaaataatgaaaaaacaggaattatgtttatacttgcaaaacatttttctgctaagcttcattatagcaaaaaatctaatgttaaaaggaaatggaaattcttgtcactgaaatttacttgaagatgtcatcgccaggaaaacaactgaggaaaactgttgaagtgatgaagaaggaggttaccttctaggactcccccggtgctgtctttctgcggagcccccttcttctcagcctctaaccagccacccggggagctgagtccttccccccggcgcccaggctgctgcgcggagctcagacacacgtccatagccgg

SEQ ID NO: 2204 - DNA, 4584 bp, Homo sapiens
gatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagaga

SEQ ID NO: 2205 - DNA, 5802 bp, Homo sapiens
gatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccattttaataattcgctgcccgtctcatgcctgggggtccgggcgagtcctcgcaggccccgggcagagccgaggcggcttcgcagctcttcccccgctcgctgggagccaagcgcagagaggggcaggcggtgccggtggaggatgcgcgaggccctcccgccacgcgcatccacgggggccgcagggtactcacagttgaagtcgggcatcttaggcaggatcatgcccgcggtggacgcgcgcagccactggtccagctggaaggtgccggcgcccagcttgatggggtcggcggggtgcgcggggtgcgcgccttgcacctgcgggtacgagtaggagagcgccgggtgctggcccgccagcgcagccgccgccgccgccgcggagtagccgtagaccgggtggccgtagagcgccgcctgcgccgggaggcccgcgccgccctgcgcgcccccagggtgcagccccagcgccaggcccccagcggcggcggcggcggcggcggcggcggcagcggccgctgcgcccggatgcgcgtggtggtggggccccccgtgcccgccgcccgtgccgccgccgccgccgcccgcgcccaggaagcccggcttgggcagcagcgcgcagtgcgcggccagcaggcgcggcggcgacgggctctcggcgcgcaggcggtcggcgggcgcagccggcggctccgaggacgcggggctgcagctgccgctagtcccgccgctcgccccgccgccgccgccgccacctccggtgccagatgcggcggcggcgagcgacgtgaccaaggccagcggcgcgctctgcgcagaggcggctcgtggggggtccaccgccagcagggcgtcgatgcggaaatttttggatttttccatcggctcgtttggggctggcgctcagggcccggtggcgggcgacgcggccgtgtgcgggctcgcggagtcagtgcgtgcggtgcaagcccgggggctcggtattgttatggtggttatttgccaataatcaaagtcgccgccggaaactcagccgagggtgaccatggtcccggcgcctcctccgtgcgggccccgccccgggccgcgctcgcacaaactcccacgcgagtgcttccccgcgtccgggcccgggagcccggttctttgcgctgcagccctcaggcgaccgcgcggaggccgctg

SEQ ID NO: 2206 - DNA, 65646 bp, Homo sapiens
atagatctaaatatatattcgattttattagatgaaaaatgcagcctctcacatcagtgggggaaaagaggtactattcaataaatggtgtcagaacaggtggttagctctctggaagaaaatgaaaggatcagatgtcccccataaacaactactctactcagtaggaagaaaaaaacccacaaaacaatagcattagttcagttcagaaaatccagttcaagccaattattcaaacagtttttgggaggtaacactgtccctatgggaagacttggtatttttcagatttccctgctgtttatcaagatggcatatgggtgtagggagaagaagaggtgctggagccatctatccaggtccctgtactctctctggccctctggtctccacagcaaatgcccctgtccaccttgtctctgggcacatctgatgataacgtctgtggctggtttattgaatttgttctaggcttgtgtcccccaccgaccacctggctcatctcagctcccagcggcactgtgttacccctgaggttggctcctcttcaatgtccagaccgctgagccactctgcagtcctcaaatgcagagtgattgggtcactctccatggtgtccatgagaggctgccagccacctcggtggggtcctcccacaatcctccatgtggcacgtggggatctccaaatgacttctgtgcaacaacagagccgagcccggtcccaggggctggatggtgtccctccctctgatggacaccagcacagcacggactttcccgtcctgtctcttcatggtgggtgaagagcacagggagagtgtgcttcctggctgtgtcctctcagaggccctccagtccagtctactccggccttggagatgactgccgagagagggagggcgggctctgggtcacccagcttcatcctcttcatcttgccagttcaccagaggcagaagggatgaaggttccccgatccccttctctcctaaactgcccctagagctagtccaccaggcttggctcctaatgtgttaaatgggggtgaatggaatttagaagatctctttttctgaaaactatatatggctttcaagacttgccttgagactcagagctgtttcacaaccctttgttccaggcagggcccaggatccccttccaaattactgaggggcagtaagtcctggcactcagcacatggcaggaaggtcacttaaccagggaaataagtatcagtcaagttaatgtttccaaaatatactccttgtaacagacattacctaaatttggaaaagtgacacaatttcaagcagcagtcaactaaaacgattccttttgcaatttaggttaatatcataactataccactggagagaaaggacaatgaattagacgtgtgccacatacttctctcaaaaactttatgactcagttgtctggaagttgttttgtaaccttctaaaattcacacgtcacaaattcagaatttactataattataatcctgaacaatcaggactgttagcttcccacgatgaaagaatgactagctatgatgatttatatttcccaagaaattaacagcaaaagttcatatttaacctcattaagataataaattgctttaaacaactttgagcactttcttagacactagtattacatagtaatattcactattcgttaactgctgggaaatttaaaaatgtttgttgatactctctgttgctatgtgtcattgaaaaaaaatgagaagaaccaacgaggtcgctgtggtgtagcggtgagagcgtctgagactctggacaaggcctttgctgtgaaccacggggagaaggtggaagcagagtttgtggtcagaaggcctcgctctgctctacatggtctatagaccgctgggaaggtggccaggcacttcccttctcatctccacctctttctcatgaaatgggcgtggtaatagcccttaattcatggattgtcttgaggattaaaagagatggtgcatgtgaagcttttagcatgatcatggcatgtagtaagcactcaatacatggtaactactagcattatattgatattaccttcagcaaataagttgataacattatatatgtaaacatttatttaaagtatttttgtacaattccaggcataaagtggattctttatatgcctgttttaaaaatatgctgctttaaacagttctacaattcacgctatttattaatggccttttacccaatctgggacactattacagttgtggctttactcaatctcttccttttctttgggtaatcttttatcttgaactaccaagagtagatgaattgtgagctcatatagctggaacaaatctgacattgttggtttgttcaaacaattttttcaaatcagatttacagagggatagaaatgagaaaaggagttttatgttaggaaaaaaatggtttctgagaattctgaggctctgatctgatgagtgaagggaaccacaggcttatctgcacatcacttataccatttggtgagatctctggagaatggaacaccttcacagacaacatcagggataaacctgatcaccgtcccctttgttgccacatctcgcagcttctcccttctgtttttcctctcactctgactcgaggagggccctcagcgcagagaaaattaagtctagtgtttgcaggagggcaagactgggagtgctgggggtggggaggccagagtccaccactctggcaaagagcagtgtttatttgtgtgtttgaacgtttgttccctttgaatatgaaagaaaaagaaatgaggagtaattttagtaaggaggatttctaaagaagcagtcatttgtcaatctgaaattttttttaaaggaagaatacttgggttgggcttacaagaaaaataaattgcagtaagtgttaaaacttgccagtcaattacaggaatatattagtgttccatcgtagtttctaaaaccagacaaaatcatttcttgcaagcaggtaattccacagaagtttccaaacccatgagtttcactctcaggttccctctaggagcagaagtgcaggtttgcttgggctcctagcctctccctcagctccctcttttccctctaatggatccctagatgctactgatggctcccctaactgacggcaaattgcttgtgggcagggtctgtgccttggtttacaggtgtacatccacacagctcttagcacagtatttagattcatcgagtatgtgtgtaataaaaggtgtggctacgaaaaatcattttacaatattgtctggcacatggctgggaaagatcctgaggctctggagctggggtgtatgggacctggagcaggggtgccctacaactttgcccatttttattattctgccagtgtcatcccctcatttctacacttcctcaggatcagaggcaggcacacagggcatagacagaatatgacaagtcagagagaattcgaacacttattttaaccttttcaccaaatttttgtcagagaaggaaatgaagcaagataccaaggtcaaatcctcctctcttttcctttttcctatccgctcttctggtggagatgctcggctataaaacggctcaaaagaacagctagaacatggaaaaagcaatgtaatcagctggtgctgcaaagggcagtgatgtgtggacgaaggggttgctggggtgacccaggcagcaaggaccctgagggggcaggtaaccagaagctgccttgtggaggaactaaacctccggaaggatttttttttttaagaatgaaatgggccgggcgtggcggctcactcctgtaatcacagcactttgggaggccagggcgagtggatcacctgaggtcaggagttcgagaccagcctgaccaacatggcaaaacctcatctctataaaaatgcaaatattagcccagcatggtagcacgcgcctgtaatcccagctactcgggaggctaaggcatgagaacctcttgaacctgggaggtggaggttgcagtgagttgagatcgctccactacactccagcctgggtgacagtctcaaaaaaaaaaaaaaaaaaaaaaaaaaaagaaatgcgccaagtctcaggtatttatggactggtgaagagttgtgtggagggtggcattcccatcaaggtggcatcaggggcagaaatggacaaaagaactccaatgacatcattgtagaagatgtgggccacagagctacatgaatgggcaccaagggaggtcttaaaatctgcaactaggtatgagcccaaaggcactggagccattctctgagtaaggctagtcaaggtgatgatagaaatgcccaatcttttacacaggcacaggagtcagctggagcagaagacctgcagggagaagttgaattttcttctctagctatcccaggccacccagaagtcaggggatgtgaccaaaggaaaaggtgatcagaaggcaactatacctgctagcacagtgatgtcactgagggatgtcaatgccatcctctgctcttatgtcctgcagggatatgggaattagacttagttctagtagacgtagttctagtagacaggagactctggagtcctaattcaggtcagtttcccagtgatctgtcctcagttttttacctctcccctccccacactcaccttctaagttcaattaataatgaatataaatgccacaagccattaatgtgtgagattgtgatccagggaaaccgacaagttagaaatttgcaatatgaactcattcattcaacgaatattagtttacagcccatgggcaaagtatgagcaatgtagagacacagcaacgaattacaagggattctttacccctgaagcttcaaatgaatataacattaattttctcaaatcctttcatataaaatccccaagaacccccttcagtggttctctagagagatatttttttcttcagagactttcataatataatctatttgcaaaacaaatggtcagaggggagaaaaaaaaaaaaacctgaagaaaccaaaactagaattatcagccaaaaacagagaatagtaagtcttatctgaaatatactgtgataggccaggtgcagtggctcattcctgtaatcccagcactttgggaagctgaggcaggaggatggcttgagcccaggaattcaagaccagccggggcaatatggcgagaccccatctctaaaacaaataaactagccgggcatggtggcacacgcctgttttgaaaccctgagaaagcttctgaaaccctgaaaaactgaaaccccgagaaaggttctaggggatgatttgtctcttaaaccaaatttattttcccttaattactatatgcatttaattttaaaaatcaaatctatgaggcttctatcaaaaattatcagtccctggcccagttcccccacctaagttcatccacagagttaatacttcccacttcgtcagctctttattctgctgcactaaattatatccatattgtatgatcttgaatcagctttttagacatccactgacttccagttgtggtgggtgaagatttcactccccactgccatgtcaaagctggtgttcagacagtcacactgttacaaacatatggattgtactggttggcacagaagcctcctcactatccctgccactctggctgctccagctccatgtcctgggacaccctaccctgccccaggacccagcagctataagggcctccacaccccaccttactgctttaaccaatgtccatctaactgttcagtgcctgtgctgtactaattgctaattcccatcctttagcctcccagtgtaactgtcccaattttttttttttttttttactgaattcagattcagggtttttattattatggctatataaatattgttcactggagaactaatttgtaaccatgattacatttctttttttgtacagctttctgcctctactgtagtgaataactgccttattttttgtttctttgaacatcttaatcatattacaaaacatctcctttatacaattttctgcatagttaacattatcactcgtgttgtcacttttatttttttctgaaaatatctcttttggagtcctacatagtcctttttttttttttgagatgaagtttcgttcttgttgcccaggctggagtgcgatggcgtgatcttggctcactgcaacctctgcctcctgggttcaagcgattctccagcctcagcctcctgagtagctgggattacaggcatgcgccaccacgcccagctaattttgtatttttagttgttggtcaggctggtctccaattcccagcctcaggtgatctgcctgtctcggcctcccaaggtgctgggattacaggtgtgagccaccgcacccggcctacatagtcttattccaacctggtctgcctagtctccaaatctgctgattagttagtagcctgtagactcgagtgtgctgtgttttgggagccttagtttcccagatcccatggctgctgcttttttggtttaccctttggaatagagcacagcccctggtagaacccccaaacgggatgccttggaggtaattttttttgacgctttgcatatctgagatatcttttagctaatcatgcacttgattattagtttgactgtgtataaaagcctaggttgtatatcatttatgctgagaatatttctccagatgcttctagattttaggattgttgtttagtaatctgatgccattccaattcctcttggtattcctcaggtctgggaatgtttcttgtgttatttctatttctttattctctttttaaattgagatatactttaccatctcactcacccttttaaactgtattgttcaatggttttcagtatattcaacaagcagtcgtgaatcaccataatcaaatttagagggttttcatcaccctcaaaagacatcccaggccaggcgcagtggctcacgcctgtaatccagcactttgggaggcagaggtgggcggatcgcttgagctcacgagtttgagaccagccacatagcgaaactccgtctctacaaaaaatacaaaaattagctgggcatgatggtgcatgcctatagtcccacctacttgggaggctaaggtgggaggatggcttgagttgcgggggcagaggttgcagtaagccaagatagcaccactgtactccagcttgggcaacacagcaagaccttgtttcacaaaaaaaaaaaaaaaaaaatcccatacccattagcagtcacttcctattccttccaccctctccatctttccagccttaggcagtgacagatctattttttgtttctgtagatttgcctgttctggacagttcatttacatggagtctacaaaattcagcagtcttttgtgagaggcttctttcacttggcatgttttaaggttcatctacactgtggcatttaccagtacctcatttcttcttattgccaaataatattctattgagtggatagtccacattttatttatccattcatcagttcatgaaagttcaacctgctgctacaaacatttgtgtgtaagttattgtgtgagcatgttttcaattctcttaggtttagaacgtggagtaaaattgctgggccatatggtaactgcattatctctttgataattttgactctgctgctttttctgcatgctatctctggaatgggtatcgattagactttgaactttatgaacttattctctttattcttacttttctaatttgccatttcttaatctttctgttttatttttgggaaaatttcattttatctcccagccctcccactgaatttttatttcaactttcatatttttaattttcaaaaactttttcttatttactgaacattatttaatagcattccgattttccaaaaaatgtatgattttctcttctttctgggagtacagtcatcattctgggattttgctttgtatgtatctgttttctttgaggtcctttattctctttggtttttgttttaattcactcagttaaccactatgcatcgagggcccatcatgtgccagcaattattccaggtggatggaacaaagattcctgccattaagggacttacagtttttgggtctgtctttgatgctggagacgctcctcaaatatttggtgaatcagttttgtgcatttttaaaatataaaacttaaataaagtgcagaaattttaagtgtatagttcaacaaaattttacatacatatacagccatgtgagcaccactcagatcaagatacagaacattttgctcacccaaaaatgtttcccgtgccattcccagttaatatctcccctctccccagagggaaccaccatggcttagttttgcccattctgtgattccatacacaggatgtattctcttgtgcctggctttgcttcttttattcaatatagtatctttgatattgatccacattgttataacagtaatttgttctttattcctgtattccttccctgattatttgcctaaaacattcaagactgctcaaatgccacctcttctacaaagacttccatgactactcccctaagttccacacatacatctatcataccatttgctgcatggcattatcattgtttgcacactcatcctcttcactggaatatgaccttcctgaaggcaacacttgtcctgagtgttttcatttcctttatcaaaagaagtaataacagtgatcatagagtactcatatgcaccagttattagtctaaggccttcacattatgaactcatttacttctcagaataacgctatgaggtaggcataattattatccccattttgcacatgagaaaactgcagcatagacaggttatgtaacttgcccaatgtcactgaactaataatggtagaactgcaatctgaacccagatgatctggctcagagactatgctctttaagatctctgacttttgatcatagacaggttaagtaacttgtccaatatcattgaactaataatggtagaactgaaatctgaactcagatgatctggcttagaggctgtgctcttaagatctctgacttttgatccgagtaggtgtccaactgtatgtgttgaacagatgaataaatgaatgaaggtggatagagaagataggtgttcaccagaaatcaaacaaattcagccttagaaaagaaaaagtacatcttacaagatgaaatcatactgtttgaagcaataaaaaatttggttttattcactttgtcctctacggagcccaagccataaagggccagggaaagaggtctaggataagattttctgtgggcttgtgttatggactcaatgtttgtgtccccctaaaatctgtatgatgaagccttaactcccatgtgcctatagctgtatttggagatggggcctctaaggaaataattaaggttaaatgaggccataagggtggggctctgatctgatacaattggtgtccttataagaagagacaccagagagcttgcactctgtccctctctccacatgcatgcactgaggaaaggccatgtgaggacatagtaaggaggtggtcatctacaagtcgggaagacagccctcaccagaaactgcatttgccagcaccttctcatggacttctagcctccagaactgtgagaagtaagtatctgttgtttaagccacccagcctgtggtattctgttatagtagcctaaataaacaaatgtagattttggtaccagttttcagaaaccagctttgacagtgttctctcttctttgggactagacttaaccttcttgtgttcttcttattattattttgaaacagggtctcactctgtcacccaggctggagtacagtggtgccatcctggctcactgcaacttctgcctccagggctcaagtgatcctctcatttcagcctcctgggtggctgggactacaggtgtgtgccatcacaccctgctaatttttgtattttttgtagaaatggagtttcactatgttgcccaggctgggctcaagtaatctgtccacttcagcctcccaaagtgctgggattacaggcatgagcccaccgcgcctggctatttcttttctgaaagataattttaagaccctattcaatccagactctttttatcatagagcaagatttgattttcaattttttccttcaacctttccaattccttaaaactacagactttcttgcttttaatccttagcttactagttcttggcctatgcagaaatgcaacttctcctcttacacagtatacttattcaatattattactgctattggtcatgcttttcttagttaataatgctaatacgtactgtctttcccagtggtatttctattttaaactctgctataactatggagtaaaactttgggctctcaagaggatttcaaatctcagctgtctgcctggggactttaaaatataaccattttttaaaaacttataaaaatttccaacacaaagtagaatatagtcattacacagattcaacattaacaggatttttgtcacatttccttaatcgattccttgtttctctgctgaatacttcagagcaaatctatcatgtcatttaaaaactctatgtagcacaatatacctctcttaaaagggagggaccatgttcttatataatcaaaatgcaagtagcttatataatctaatagaattaacaataactcttttgtttggggacctctgaagtgaaacaaatcatacagaattttaatactataaaaacattagcactgtaaaaacagcaacatattatacagcctcaaaacagttttaaactgaagtctagtatgttcagaaacgcagggtgctgacccaccatccaactgaagctgagctcaggaatgcctaagacaactcataaaaatacacagcatcaagatcagtctttgtacattatttcaatgaaaaacacatagctgtgtacaaatatacagatctcaaactgtaacactgaaacacaaaatgcaacaaagtggctttataagttttcttcactgagacagaccttctggtgacttctggtgaatctagacatttatgattattaatacataataagcaagagaaatacagattttccaacctcatgatcagtaaattcctttgaaaaatgaatgaaggtatcagagtcatcaaaaggggaaacagttggtaagtttgatggccctgcctacactgtataatgtaagacacacaataagagctataagaaactatagttaaatgttagaagtaaagccaatatcgttttctcagacttctcccagtgattatatacctgatatataaacatcttcaaatgtgaaatagttcaataacacaatgacactttgccagtgtattaatctgatatatattttgaactggaatgatttgtaaagaaataaataagaaaccctaaaaagaaaccattagttccaagtcaaattatgttaatggtctatagaaaaaagtgagtgtgggcaggaaacattggctacatgccaatttttatttcaaagagtaatgttgcacaaataatagttatcattgtcttacacaacaaaaaatcctaaagttaatctcacaaacctaaattagctgaacatggagtaacaaagtcaaagccagtattatcatcagcacattaatttgataaatcaaactacatctttaaaaaaaaaccctgcatctgctgctgtgcagaactgataattacttttcagcatgtaaacgaaaaatcattatacagctctctctcttttttttttttttcctagaaagatgtataccagggaaacacaacagaatttgttacttgttaaatcccacaaaagctacaagggagctgagagttgatggcacttaaggacagtaaaagtctgcacttttaatatttttaatgcccactgatgggctttgtgtcaatactttttaaaatgctttttatttacaatagataaaacagtaaggaaatacaatattatatcatatccccgcacagagatactatatctgtataaatgaatcactagtaaaagagttatttcttatttcaaatgaagtcttatctaggtattaattaggctgtaatctaaatgttgatggtgcctattttcaactcccaaaataaacagaaagagctcatgtatcaagattaattttctttggccgcaatggataccattttctctgggggcagtctttagtttgctttcttttcagtaccatgtcagaggttttcctggaagcagtctctgttggtgtggtttctatctgtgttataaagttctcaggtttagcatctggtttcctatgacaactggaaaagacttcttggtgaatcctctggaggtggataacaggctgcatcctgagaacttgggaaaatccctctccttgttcaattaatgcaggcaaggacttcaaacaaacaaacagtaatattcaacattaatctcaggttgaaacacaaacagacaaagatggatgcagtactctaattttttttttttttcttgagaagtcttgctttgttgcccaggctggagggcagtggtgtgatctcagctcactgcaatctccacctcctgggttcaagcaattcacctgcctcagcctcccgagtagttgggactacaggcgcgcaccaccacacttggctaatttttgtatttttagtagacgtggactttcaccatgttggccaggctggtcttgaactcctgacctcaggtgatctgactgccttggcctcccaaagtgcttggattacaggtgtaagccactgtgcccttgctgatccaggctttaaatgctggattgtaggttacttatgtgcgcaacctgcttagcctctctgtgcctcagcttcctcatctacaaaagaaataacagtatctgtctcataggatgtaaggattacatgagacaatacatgtaaagcagttggatggtgcccataccaattattcaatacattttagctggtattattatccaaaactgttcggtgaactgctaacacccagaacacaaaaatataatcaacctttaaagaagacaggtatattacctggcacatagtaggtacctgataaatggcagctattctaaatgttactgttgcttaataaattcattaaagatttatttaaaggaccgctgagaattcctgttagagcagactaaaacacatatgaatgttgaatgcaaatacctagccatacattttgttcatttgataatttttttagcacatagcttttaccttcatggcttcactgatctcctttgctactgtttcccctctgcatttcaaattttccatatgaggggctgcaaaaacattgccaaacagtattttaggtttttatctaatagcaaatcataaaaggcatatagatactatctgaaaggcatatagatgctatctggacaaaaatctgctaggacgattcacctcagcttaatctttctcagagtgagaccattataataatagagtaaaactaaaagttataagcataagatggtacacaaaattctattacgagtagtcataacactgtgtgcccctaaaagagagttcaatgttcattctatacattacctaccactatgtttaacatctttgagcactatcatcacatttttaaataaatactttttatattactctgaattttataaaagtaacacatattcgatcttagaatatacaatcacactgcactgagatcatgcctagatggaattaatctggaacagattatcagtaatactactttctctttccttacttcctaatacatattttcttcttccaatctttgcatattcaatgatacagaaagataaaaatcttactaaaactctaaacaaaactgaaaatgagaaaaaattgttccattatgaaatcatctatgaattactttttagaagagtagttctcactagaaatttcttagagtcaaagcaagtacataactatgttaggagggccacattttcactggctagaagagattggtcaataacccaggcaaaatatttctttcataactgctatttttcttttctgacttgtcttaggttcatctttaaaaagtgagaacacatttagaaaaatggaaatgaaccacaaaaacagcttactgaaagagggcactcaaagaaggagacagacaatggcaacaggataatctcagaaaagggttttttttttgtaccagaaatttctttggcaatttggtgaaacctatgaacaccttctcagaaaaatttttaatgtacttgttttttaaattgaggtataatttatatatagtgaaatgtatagacagtaagttcagcattcaattgacaagtgtataccaagacacaggacattttcatcaccctagaaagttctcttgtgcccctttcccagtcaattttctccataagaagcaaccatttatctgattttaatcactatacattagttttgcttattctaaaatttcagaatgttttaaaataaaatttaaaatgtaagtagaaaattgtgataggtaatatatgtgcttctttattgatgatttaaataacaaaattgatggcatagtgattaccataatataaaaacaatgagtgtaaacaacagtgtgaggtatctacaacaacagaaaatgaaaatatctgtagctttaagtaacagaaagaaagttagtgatactgataacatcaccactattacctacattcaaaatggaaggaaatgctaaatttcagtttgaggctagtaaaaataaaaatgtattttttttcctatacaagttcacaggagggtcctaaggatccttgccttgaaataacatcataatttctattatttacgatttgaggagattccccaaaagtactcaggggcataacaattgttaaattttctctgtggtatggcaaataaataattcatcctttggtcctcctgtggcaatatggattctagccaggcccacacttactctctcttcaagcttgcacacctgtgtaggagctatctgttcaacgaacatttatgatgtatcttccatgggctaggcttatgatatggtttggatctgtgtccccacccaatctcatgtcgaatcataatcccaatgttagaggtggggcctggtgggaggtgattggatcacggggcgatttcccccttggtactgtgttatgatagtgagtgagttctcatgagatctggttgtttgaaagtgtgtggcacctcacccccaaaacagcttcttcctgttccatccatgtgaggtgctagctcttcctttgccttctgccatgactataagtttcctgaggcctcccaagaagctgagcagatgccagcatcatgcttcctgtacagcctgcagaactgtgagccaattaaacctcttttctttataaattactcagtctcagatatttctttacagcagtgtgagaagagactaatacagctgagcagtaggtacttataataagtaaaaatggtccctgcccatcaaggaacattcagtttagaagagagaaacacaggaagttcttcaaaattagctcaaacttttcctgggtagtctcatgtttccatgatctcggttaacacatacctcacctcctgcctgaatggaccctgccttgctacaggctcccactgggtcctgcacagttctagtacaatgcctggaagacatcattgcactaatttgtgtagaataaatttctcaaccctatcagacccgacccaacaccaccccccacttcagaacatattttgtaaagatcccattactattctaaagcaaaattcataggtaatatttctacacatataaatagaaataaagggagaaataatattcatcaaaatatgtacttaatatgtttaaatatgctcagacccaactataccaaagacataatgaagtactctcagacttgtgcctacttataatgagtaagcttggacttaagaaaatttacatttgaagccattctatacagaaagcagaagatcagaagtatggatggaacttgaataaaacttaatgttacataagaaataatagattagatttatttgaatataagaggaagaaaaactgaaatagagataacataccaagacaaagtactgactgttgaactggtgaaaattaggaagtacattatttctacaaatgaaatgtccttattaaaagtgtagtgtcaaaattatcccctataacatgaaaaagtgcgagattaaagtctaccagaaaacatatctcctgcttcaaaattcccataatttagactatagtcaatatatacattaacttaaaaagacttcaaagatcatactgtcgaaaggtgatgagaaatagaggatggattaggcaaaatattaatacaagaaactatagagatgatatgtggctgacctctgtagttaatctgactgacactcaaaacaggcaattcaaaactataattagaatactttaaacattttaaatcttcacataatttcttatcattgtggtacaaaaatataatttttaatatttagtttgacaatagcaaatatacctaaaccacttttgcttaaaaaaaaatgagatccctgtattttgtgtgcttctgttaattcagtaacatttggttctagtcctaaggactctcaaactttgttacatattttccatcagctttgctgcttttgcaataactaaatactgcatttaattaaaatcccttttaattaaaattgttggaaatgctctaagtaattccttaggaaaaaacaggtatgaaagtctcaactgaatctaaaacatttacggattaaatgtagctctagctgcaaagatttttgtttactttggtttttttttctttttttttgagatggagtctccctctgtcgccagcagcgagtgcagtggtgcgatctcagctcattgcaacctctacctcccaggttcaagtgattctcctgactcagcctcctgagtagctgggactacaggcatgcaccaccatgcccagctaatttttgcatttttagtagagacagggtttcaccatgttagccagaatggcctcgatctcttgaccttgtgatccgcccgccttggcctcccaaagtgctgggattacagccatgaaccacagcgcctggcttatttgtttttttttttttagctcaattttcccttcctccacatgttcattaacaggttccatgtatactccaaatatacttcatgtatattcaaattcttaaataccttgtatatacaatctttaaatataatcaccctatcttaaaaatagcatgcataggagtgacatcatcaaaaatggtggcataggagattccaaaggcccatccctccacagaaaaaagctggcaaaatctgtcacaatcaactttatcaaaaatctggaaaacagtcaagggttttcaccaatcaacagaatgtttaatcaaggcaagagcaagtgaaatctggtaggagaacttggtatattttaatttacccttgccccattcccttcttcctggctcggtggcagtaattcccagagtgggttactggtgctggagataacagagtagactctgctctcaaagaattgtattgttttgacctggtgagtggctctctgaaggactaacacaaaaggcttgcctttatttcacctgatttggaactctctcagggtggaaaagtggttacctggaggttatctgttaaaaacattgaaaggtaacgaagcagcagatgcagcgtgcagcacaggaagtcagttggggcaaacaaactgcttgctgaaaagctccaaacaagcaggatgggaaggcaaaggccgttatgaactgcctggctgagagctgaaggcatatcccgacatacacctacagagtttaatgttttgttttgctccaggcatttaaggaaatctctgacaaatcactagctgaccactaagctaatggaatggagacttcagtgactacaaacaacaaaaaacatggtatttccaaaaaagctttagaaaagtcactaaacaaacaaacaactcaccacaagcagcaacaacaaatcctgggaagatggaagaatctcatttctagagttaccatattaaaatatttgaaatgtccagttttcaacaaaaaattatgaggcatgcgaaaatacaagaaagtatggtccattcacaggaaaaaaaggaaattaacaaactgtcactgaggaggttcagacactggactgactagataaagactttccatcaattatcttaatatgctcaaagaactaaagaaaacctaaataatgtgtgtcaccgaacagagaataccaatggcagacagaaattataaaaaggaacaaaaaaaattctggagctaaaaagtataataactgaaatgaaaaactcagaggggagacggtgagtgttcaacagcagatttgggcaggcagaagaattaaggaacttgaaggtaggccaaatgaagtctaagagatctgtgggtaccatcaagcccatcaatatatgcataacaaggccaggtgccatagctcacgcctgtaatcccagcactctggaaggccaaggcggccggatcacgtgaagtcaggagtttgagaccagcctggccatggtgaaaccccgtctctactaaaaatacaaaaattagctgggcgtggtggtgcatgactgtagtcccacctactctggaggctgaggcaggagaattgcttgaacctgggaggccgaggttgcagtgagccaagattgtgccactgcactccagcctggacaacagagtgagactccatctcaaaacaaacaaacaaacaaacaaactatatatatatatatatatatatatatatatatatatatatatgcatatgcatatgcataacaagagtctcagaaggggaagagaagagacaggggcagaaaaaatatcttaagagataatggccaataacttcccaaatttgataatacatgcatttacacatccaagaagctcaacaaactccaagcatttacacatccaagaagctcaacaaactccaagcagaaaaactcaaggaaagccacatcaagatacatactaatcaaactgctgaaagctaaagacagaatcctgaaagcaacaagagagaagtgattcattacatataagacatcctcaatcagattaacagccaatgtctcatcagaaaccatgaagaatagagcactgggaggatatggttaaagtgctgaaagacttctaaaaaaatctgtccaccaagaattcactatctgccaaaaatatccttcaaaaatgaaggtgaaattaagacatttccagataaaaactgagggaattgtctggacacagtggctcatgcctataatcccagcactttgggaggctgaagtgggcagatcacttgagcccaggagtttgagaccaacctggacaacatggcgaaaccccatgcctaccaaaaatacaaaaaaatcagctgggcttggtggcacatgcctgtagtcccagctactcaggagactgaggtggatggatcacctgagcccagggaggctgaggctgcagtgagctatgatggcaccaccacactctagcctgaatgacagagtaagaccccatctcaaaaacaaacaaacaaacaaacaaaacaaaacaacttgaaggagttaataattagtaaacctggactacgaaactgctaacagtgtttcaggctgaaatgaaaggatgctagacagcaccttgaagccacacgaacaaataaagaataccaataaaggtaactacataggtaaatataaaagttagtttgtgacgtctcctttttttctacataatttaaaagacaaatgcatcaaacaacaattataaatctacattaatggatatacaatgtataaagatgaaatctgtgacaatgacaacataaagggggagaaacagagctgtatagaagaagttctatacagtattaaaactaaagtggtattaattcaaactacattgttataaatttcagatgcaaattgtaatccccaaggaaaccactaaaaaaaacccctaagaactatacagaaaataataaaagtggcacacttcaaaaagctcaattaaacaaaaaagaagacagtaatggaggaattgtggaagtaaaaaagtatagaaaacaaataccaaaatagcaaaagtccttccttatcagtaagtgtaaatggattaaactttccaattaaagacaaaagttggcaaacggataagaaagacatgattccaactctattctgtctataactcactttagatccaaagacaaacataggttgaaaatgaaaaaataaactaagatgctccatgccaaaggtaagaaactgcttagatgagttgcacaactttatgaatgtgctgccagtgaatcatacacttcaaaatggttaaaatggtaaattttatgtgtactttgccactgccacaacaaaaaataagcatccatatgtgtggtagtcttcaagatggcccctgtggccaggtgcggtggcccaggcctgtaatcccaacactttgggaggctgaggtgggtggatcacttgagccagaagttcgagaccagcctggccaacatggcaaaactccatctctactaaaaacacaaaaattagccaggcatggaggtgtgtgcctgtagtcccagctacaagggaggctgaagcacaagaatcactggaacccaggaagcggaggttgcagtgagctgagatcgcactgcactccagcctgggcgacagagcaaaaaaaaaaaaaaaagatggcccccagtgatctctgccttgtgcagggtattcatgcctccttgtgcagtcctctcccacagtgtactaggtcagcctgcatgaccagtaactaacagctcaagtaatagcaaatcacttccaagattaggttataaaaaagacaacttctgtcttgggtattcatttattcattcattccctatgcctttcagatcattcgtcctgcaagaagtaggttgacatgttacagaagcttatggagaggcccacgttgtaaggaactaaagtctctaacacaccagccagggctgtactgccaacaactatgtgagtgagtttgaaagtggatttcccacagtcccaggtgagccctgaaagataactgcagctccaaatgacatcttgactacaaccttgtgagagccctatgctagaactacccagctaagctgctatcagattaatgaccctcagaaacagtaagagataacacatttattgttttaagcagctaaactttgggataatttgttaggcagcaatagataactaatacaacatgagagcaatatattttcaaaggaataaatttaggcttatcttaggtagaaataaaattcctagtgagatttattttcttttttctttttttgacacagggtctcactctgtcacccaggctggagtgcagtggtgtgatctcggctcactgcaacctctgcctcctggttcaagtgattgtcatatctcagcctcctgagtagctgggactacaggcatgtgccaccaggcctggctaatttttgcattttttggtagagatggggtttcaccgtgttggtcaggctggtctcgaactcccaaccccaagtgatccttccaccttggcctcccaaagtgctgggattacaggtatgagccactgtgaccagccttactttcaaataatatatgattgtagataaatactataattccttcactttaatgtgatttatgtcatcttcttgcagtttcaaatatatttaatgatatgataatatctgttaactttttacttatcactgattgaataaatattatgtaatctagtaacactatgaattgttgttagggatatggaacaactgtaactatcatacctgctgttagaagtataaattgaaataaccacttcagaaaactttttagtaatagctataaaagccaaacatatgcctacatgtgacccaaaaattctatttctagatatatatctacgagagatgagtataaatgtggtataagaatgttcatagtagctttattcatatagccaaaatctggaaacaaatcaagtaacaacagaagagataaattgtctgtagacacacaatggaatactacacaacaataacaaagaacttctgctacattcaaaacgtggatgaatctcataggaataacaccaatttaaagaaggtaacacaagaatgcatactatatgattccatttacatgaagttcaagaaaagacaaaaatctatgatgatgtaagtcagaatagtggttatacctgatagaaatggtataatgactaaaaaggggtatgggaaacattttggggtactggaaatgttatacagggtatccataaggctggggaacaggataaatatgtgctagttacattttcaaataatatgttcaatatctttttcttcaacctcaatatatttttccaagtaaaacacttctaaatttaaagcagtggccccaattgtgaatatttttaaaaatacaataaacgcactgttttctttatgcttccaggttttttggacactctgaattgtatttattgtatacatgaaaacataataggcacagtattaaaaaaatataatcaatatactgtttaaaaataagtttatcctatattttccaactatgcagatattctatttctagatcatggtggcagttacatgtgtgtaggtgtatgcatgtaaataaattcataaagctgtgcattatatgttatactgcaatatatgtgcacacacacatacaataatgaacaaaatatttattaacatttaatatgaaaagttatcttttatgaatagggtaaggtaaaatcatattcttcttcattgttattatattgtttacattacaaactttacaaaataatccatcacttaagggattttgcgttttattgtgtttttttttttttttttttttttgagacagggtctcgatctgtcacccaggctggagtacagtgatgtgatcactgctcagtgcagcctcaaactcctgggctcaagcatctcactctgtcacccaggccggagtgcagtggcacgatcatagctcactgcagcctcaaactcctggactcaagcagtcttcctgccttagcctcccaaagtgatgggattacaggtgtgagccactatgcccagcctacactttattttttaattaacagcactgataaccatattcactgatttgtgaagcctctcactaggattcttagagactaagcgccatcaatgaccaatataaagaattcttaaaatatctcatgctaccttaaaaagaaatttgtctctaaactcacattgctgaacaacagctgttttctatcggttgcacaagcaatgacaatgtaaaaagtgctaagagtagtttgggtttgtgtgtaaaatggaattaggtcctaggctgaataattataaacatattttaacaaatgaatgtctagtgagatatcctaaagttgtgctggacatatgagacatctagtatgcctggcccctgactacaaagtgccagctacactttcccattaatatggcaaccaaaaactttctttcactttttcaaagggtccactagagggcagtactaaccccagtgagaaccctggcattctcatttagcttccagaactcccttgggaacaggaaacacattcttttaatctcagaatccctaatgttgaacagagtgcctaacgtgtacagtaggtgttcagtagtcatgatggaccaaggctatgatagagggtgccatggaggcacaaaggagggtgagatcaatctaacaagggaaccgaagggagagggaaatcttcacaggtgatgtaagaaagttgccttaatagaggatttggggctaggtgagctgggaggaggtgggtggtagaggatgtgatacatcaaagacaagagaataaatcaagaaagagtagaaaacaggaaccaggaaacacgatttaaaacatgagagaaggaagggaaattcccaggacgatgatgaaaggaacaggcaggatgaaaattttgcaccaggcctagacagcagccagtccagactggaataggaggacagaaggttcccagagaagtatctccgaggaaaagataaagtttaaaaatggatctgagagataaccttaagtgtttgccatattgagatgaattttacagttctgttagacacaacagaaaacaaagcaaacagaaaaataggccaggtatggtgagccacacctgtaatcccagcactttgggaggcagaggcaggtaaatcacctgaggtcaggagttcgagactagcctggctaacatggtgaaaccctgtctctactaaaaatacaaaaaattagccgggcatggtggcgggcgcctgtaatcccagctactagggaggctgaggtgggaggatggcttgaacctgagaggcagaggttgcagtgagccgagatagcgccactgcactccagccagagtcacagagcaagactgcctcaaacgaaaaaaaataataataaagcaattattgttccaaaaggggtagaaagctattcaagaaagaatatactcgtagtaataattatctgactcaggaacaaaataataattacctgactcagattgaagaacacttacatagtcataaaaatacaaatatgaaatactattgattttttttacaagaatgaaagattaaaagtgaagctactgagtatagattattcatttgagaaacttagttataaaaggaagaagggtacaaggaagaaaaacacaatggcatgaaaactttccctacctgttccatggacagcccattcctatagtagtatgggctgacatacattctcaatcaatcttatgcaattttagcaaccctgggaggcaagtgggtttcatcagcctccttttgtaggtaaagaaacagaagctgagaaatgtatctagacttgaataagaactcacatctccctcctagaatccaaagcacacactcttctacattctataactttccaaaatactgctttgtcaggaattatactgtcctcataagaatataagttaactaatggtaaaaagttagcttcaacataatgaaaatctcttgaaataattgtgcctggtaaagaactaaaacattaaaactctagaacaattatagaattaaatgtttaaactattaactttatggtacctttttttctttttaaatgaattaagtcctttacatttaaaactaagtagcaccaataattaataaaaccattttttttaaagacaaaagaaggaaaacacaactaaaaatggtcactaaatatatgaatatattatctgtaaatgcatgaaaaaggcatttttccaacaatatctgcttaggaaatttcaaaatatatatacttttcactccctcactcaagattattctaaatgaattttttcacattttgcaactagtaagatcatacaatactcctgatatacaagtatgtgacttaagactgtctcacatgcagatggctggtccatgccacacaggagatgggatgggctttctcgaggaccattctcaatgtcttctctctagaacctcgtgacaccactacttacccttctcaccaccaacaatggtgttaaaggagccaaactattccatataaaatcctacttaaatgtcatatagtggaactaatatgcatctgaaatatgattttcctaattttttcatcataaatgtatagtatttcagctacattatagattaaggtttaataagcctgtaaagggttgcctagaaacatatttatttatttatttatacatttttttcccagtgggaagtgtatttcaaattccaaaactcagacttacatgaatttttaaagtgtaactatttgtgagtggctacctgtaaatattgtgacagtggcttaagcaagacagcattattaggaaagaagcggaactgcctctgagtcctctgcctgtagggtcagcaaaagaactggaagtatcattaagtttaccatacagaaacttaaaatagctccttgccatcgctacatgtttagcgaaggacagggaaaaaagggatcttcagttaatttcaaagaacttttaaaaaaaggcaatatggaagcaattattcattacaacaggattataaaaggttgtaaatgtcaaatgagaccacatcttattggtggacagctcatcagtagattgctataaggatatttttaaaaagagtttgctcttaaaaatgtggaagttaggcatccttgagaacactgccttccctagtcacttgctttctaaaacacagggaaatgaaaaagtggaaatgaaagattgagtaatcaacctagttttgctttcaggtcactgtactgactaaactaggaaacatgaacttccaaaagcctgcccaaattcagaaattcagcaaaaaaaaaaaaaagcactaagtgagtacttcctttctatttccaatgtattttatgaatataaacaagcaatcacgcacagcatcagatgtgtggcttctactggtttctaaagaggtaattaagccattagaaccaagaattagaaagcagcatccctggtgaaaatgaaaccaaaaacacagcagtgatttgtgattttctgaaagataaccctttgctacaatttatagagatgtgttgaacccatttgctcagtagatgaaatcctctgcagcacaccttcccacctacacctcaccacctccttcagtaccatgttgcacctctcttaaggcacactttcaaactcctgaccctcgctcgttattatctggcctcagccaagtttttgacattgtcttgcaatgcttcttccctctattactcacttcactacagcctctctggtcttttgttccatgaatactcaagctcattcttgatttaagaactttattctagctcttccctctgcttgacagctctttttcttgatcatcaccagataaattccttcctgttactacctcagaaaagtgtttccccatcacctaaacacaccaccctaaagcactgatgtcacttatttatttttatatttattacttttcttctcccactaaaatataaactctatagagtaagaactttgtgctgctcactaatattacatctgccacattgagaacagttctgtcatactgtagccattcaatatatacaactgaatggaccaatgagtaacagtcactcatgatgtatttattgggcatgctgctatatgctggctatatataatgtaaatataatattaaaaaactcatggagctttcagttttgtgagagagcataaacaagaaaataaacacaaatacttataagctgtaacaagtactattaaggaaataaacaggtgtcatgataaacaactggggagagtattttaatgagggtggttaggtaagatctctctgaggaggtaacatttaaatgagaaaagagaactgggaagatgtcaaacttgggcaagggggcatgcatgtgtgacagtgaggcactttcaaagaactgaaagactggcagcaaacaggaaagtgcctgaaataaatctggagaggtaggtaggggccagatcacctaagggaatgctaaaagtctagagtttaggattttaagcagaggactgaaaactgatttgcatttttaaaagtatcctaagacttcctagtcaagttgatttcagtagtgcataaaactcccttcctatgtccaaaagcatcagtgaatatagaaaattaaaatgacatatcctaaagcatatacaaaataaaacatttcaatgaaccagaaaaaaaggagaagagaaaaagctgcaagtcaggctaaagctgcaggcctaccggtaagcagaagtagccaggaattggcctcctgcaagataaaaggtgttcgaagtgctccagaagaacaggaaacgaagagacagcttcactgtttgaaaccgagggctgagacagagtttacccaccctgaaaaggtggctgaaaaaaactgccactaaccagcccggcgcggtggctcacacctgtaatcccagcacttaaggaggctgagatgggtggatcacgtgaggtcaggagttggagactagcctggccaacatggtgaaaccccgcctctactaaaaatacaaaaattatccgggcgtggtggtgggcacctgtaatcccagctactcaggaggatgaggcaggagaatcacttgaacccaggaggcagaggttgcagtgagcaaccattacattccagcctgggcaacaagagtaaaattctgtctcaaaaaaaaaaaaaaaaccaactcaaaagacaaaactgctcctaaccgctgccaggaagcaaagcttacttaaagctaaaccagaaatgatgggaagcagataatgcctccaagcctgggcctggaccaatctccagtgtcacactgggacagaggccctctgttgccagtgttaagatatggctccagcctgggattgtttggggccagatggaaggcaaccaaacctactagacagagggagtgaaagcagtggtagacagatatgcacatgaaaaattctagtcaagaagcacttgcaaatcaaaagtctaaaatacatgaagaaattaaaaccatgaaagacagccagtataaccaatgtcagggagaggaatttactgcagatgaaatgaaaatagagcaatataaaaatgactttaaaatgctacacagctccaatagctaaagaaaatcataagacattgcaaaagaaaaataggttataaaataaaaacataaaatacaaaaatagaagaaatgagaaagaagcaaagttgaaggattaggttaaagattttctagaatataggagtcctcagataaaagtatatatggagatgttaatggaagatgggagaaaagaggaatctagcaaaaccaaataatctctcacaaaaaacaaaaatacatatataatattatttaaataaaattgtctctgtgtatataagcaagaaaaaaattaccaataaaaaccatggagttgaactatgttacatgttgagtgaaaaaagaaaaacaatgacagaataaaatgcattatgtaatatttatataaacaactaaaaaaacccctgtgtctacctatgtgcatacaaatgcattgataaagatctaaaattagacacagcaaactgataatagttgcctatttgaagatgtgtgggatgtgacagattgggaggcgaagttatggtatatttcatataaatatgaatatgtatatattttcatatatatctatatgtaattattaaaaattttacattaagcttgcatttattaaaagcacaagaaatacaatttaaaagataaccacaatttaaaacaataaggttagagctacggcagtcgaatggaggatgtctaccataaacttaagctaggaaattgcagataatttgaacacatgaataaattttctgtaaattatgcccccaaaatgtccagtgcatatttattcctgtaacaattatataagcacagaaaaaaggataaatgaattcataccaggttaatgttggatatctaaaggggtgacaggaagagagagaagaaaccaaaaacaaaaagtaaaaatacaatgctatccttgttgggtttttttgagacaggttctcactctgtcactcaggctggagtgtagtggcaggaccatagctcactgcagccttgacctcctgggttcaaatgatcctccctctgcagcttcccgagtagctggaactacaggcatgcaccaccatgcttggctaatttttgtattttttgtagagacggggttttgccatgttgccctagctggtctcaaactcctgtgctcaagcgatcagcttcccaaagtgctgggcttacaggtgtgagccactgcatccggccgactttggtttttaaaagggacaatgtaatatgtaattcaatcctatttatataaaattatgtattgtttgcaaaaatataaatatttattgagtgtaccatgtcagaaaataatcttaagagtcaggggctgggcgcagtggctcatgcctgtaatcccagaactttgggaggccgaggtgggaggatcacccgagttcaagactttgaaaccagcctggccaatatggtgaaaccttgtctctattaaatatgcaaaagttagccaggtgtgatggcgggtgcctgtaatcccagctagtctagaggctgaggcaggagaatcacttgaacctgggaggtggaggttgcagtgagctgagagcgtgccactgcattccagcctgggcgacagagcaaggctccgtctcaaaaaaaagaaaagaaaagaaaaaagagggaaaactgggcatcccaaagttcttgctcacagggagcttacaatactgtggggagggaagaggaaaataaggagaaattatataatatctgtaagtggcagagaaaaataaagcaggttaaagggatacagtatgatcaagggagtcataagagaatctgacacaggttgtaaggtgtatcagatgaagtgacactttgaacagagagctgaatgaagtgcaagagtcaggcaggtagtttcggagagcagtttcaaatacagggagttgcgagtatgaaagtcgtagggccagtgtgttcttggtatgtcctgaaatagcaagaatattagtgttagtggagcacagtaagcgagggtgagatggtaagtgaacactgtcagagatgagatcagagaagcagccggggaccatatcattgagggcctcttagaccaaaggaattataatggggagccactggagggccttcaacagggagtgacataatctgattatgctttaaaagaaattgtttggatgctgtgtgaaaagtagaactggatggaaggagaccagggtgttagtctgttttattactataaaggaatatgtaagactgggtaatttataaagaaaagaggtttaattggctcacagttcggcaggctgtacaagcatagcaccaacatttgctcagcttctggtagggcctcagtgagctttcaatcatgatggaagccaaaggaggaacggtacatccatggcaagagatggagcaaggatgtggatgtggggaggtgccacagtctttaaaacaaccagctctcaggtgaattcagagggagagctcactcattaccacaaggagggcaccaagccacggatgagggatctgcccccaagacccagacaccttgcactaggtccatctacaacattgaaggtcccatttcaaccatgagatttagaaggaacaaaacatccaaaccatattaatcagtgagaaagctattatagtggtcctaagcgaatatggtgacatggataagagcaggagagacagatttggttggtaagcagcaggatttgaaatatgtttccaaggtaaaggcagcaggatctactgatggactgaggatgtacaggcatcatgcaatatatcataatactggttactggtcataaacatgctaatagtgtttatctctgggcatatgatttcatgtgatttaaacttgtttcttatgcttctaacatttttggaatgtgcatgtattgttcatacaagcaagaaaaagcaataatattattttcagtgtgaaataaatcagaaaatgtacatatcaaacaccatactagaaaataaacatctagctatactgtggtaaacttcagagcattaagaatatagagaaaatccgaaaagtcagaagagaaagaacaatatctataaaggaatggtaatcagattctcaagacactgctcatcaacaatgaatgtcaggcatccagattagaaagaaaagaagtaaaatatctgtttgcagatgacatgatcttttatatataaaatcctttaaaacatccattaaacaactattagaactaataaatgagtttaacatggttgtaagatacaagattaatatacaaaaattaattctatctctacacagtagcaaagaagaaaccaaaaataaaatttaaaaataattcaatttacaagggcatcaaaagaataaagtatttaggaataagtttcacaaaagaagtgctaaaagctggaaaacactgttgaaataaatcaatttccagatggaaagccatccattattcagggatcagaaaacttaacattaagatagcattactctcaaagtgatctacaatttcaacacaattcctaccaaaatcccagctgacttcttgacagaaattgactgactgatcccaaaattcatatggaatttgaatgtaagggatcagaagagccaaaacaaccttgaaaaagaagaacaaggttggaagactcatactttctgatttcaaaatttcttacaaagctataataatcaagacagtgtagtagtggcctaaggacagacaaagatcaatgaaacagaattgagagttcagaaagaaatctacatattacagtcaactgatttctgacacagattccaacaccattcaagcattttcaacaaatggtgcttaaaacaactggatatatacatacaaaagaatgaaggtggaaaactcttaggagaaaggcaagcataaatctttatacttttatattagacaacagtttctaaaatataaaactaaaaccaaagcaaccaaaggaaaaaaaaataggtaaattagattttgccaaatttaaaatttctgtgcttcaaagaacatcatcaagaaagtgagatggggagggggcttcaagatggctgactaggggcacctggcacctgcctcctccacaaagaaggactaaacagtgggtagataatcacatgtcaaagacagcatccaagaaaaaacagtggaattcagcagaacagtgacagggaacaactgaggcatgggaagaaagggaagcagggaaaatgtaaatgagagatcccacatttctactgcagaatcctgcagtactaaccacaggagagccccttggcccctgcaggccctaagactagtatagggagctgtctggagtccatacaacattaattccagagagatagcactgggtacctcacatacccccaaggcccaagacaccgcagcatagcaccattttgagaattcaacccccaccagactgtatccttccctagggcccaaaagcccctacatctccacatccctggagccttgctgacatccccactgcatccacctggagagctgcagtggcacaacactgactgaacccaatagtaaaaccaggtccccggcactctagcctacacagtgtcctacaccccaaggaaccagcagtgcagtgcaccagggaggctgcccgtgggacagagggagctgaagcgcacactcctcagagcctgagagccatttccctggggccacccagcagcaaggctactgcgcactggcatgtgcctttagtgtgcctagggacaggcccacccagatgctgtcctgggatcctgataatcaccctgccctatctgtcatggtgggtgtgtgagcacatcaagacaacagaccaccaagacaacagaccatcgccagtgcccaatcatactgtccagggcctggggattgacctgccccgccagctgcttctggggcacacacacacacacaccataagggagcttaacagcaggtccagcctgtgggccactggtacctgagcacactaaccaagggcaaagggatagccctgccctgcccaccacaactttaggcacaccatcaggaggctaagatcaggcccaccctgctctgcaccactctaccacaccagtgtctgagagcgccatctaggggcccaggaatagcctcattctgtctgttgctgtgggcaggtgcacacactcagccatcaaggggcctgataacaggcccagccaacatactgcgggtgcctgagcataccgtttgaggtcctgaggttcaccccactggccactactgccggcatccacacactcctccccagggcttgaggacgggcctgactagcctatcatcaccaccaccatcaccgccaggacccccctaaatgtgctctggggggactggccagcccagtccattgccaccaccactgccgcctgtgcttgctgcctgggggcctgacggttgacccgccactgctactgccatcaccaacaccacgcatactgcccagggactcatgaaaccacctgcctgcccatcccattgctgtcactgctggtacctgagcaagccacctggaggcccaagaattggtctgcctggacctgataacactagtatctgtgtacactgccaagggaaccaaaaatggatgtatttggcatgccatcaccaccagtggggcccaagaacaggcctgcctggagtccccatcccaagtaaagacctatcataccctctagtaccaaccatagcgtaagtcactaaggaactcacaaacatcactgacactgattacacccaaagaaatcatgcagagactatactattgcacacacccggaatcaaagctaaagcaccctacccaatcaatattatagatacaactacaggcaaaagtcttttcctatgaaagccaatctaaaaatctgaaagaagtaactgtttcaccaaatgtgcaggtatcaacttaaagacataagaaacatgaaaaagcaaggaaacatgacacttccaaaacaactatgataattctccagcaaaagattccagtgaaaaagaaatctataggacaggcattgtggctcacccctgtaatcctagcattttgggaggctaaggtgtgtgcatcacctgaaccttggagttcgagaccagcctgggcaacgtggcgaaacctcctctccacaaaaattacaaaaaattattagggaggaggatcgcctgaacccaggagtttggggccagccttagcaacacggcaaaaccttgcctttacaaaaaacacaaaaatagctgggtttggtggcagatgcctgtcgtcccagctacttgggaggcggaggtggaagaattgcttgagctcaggaaggctgcagtgagctgtgactgtgccactgcactccagcctgggaccctgtctgaaaaaataaaatataaaaaataaaagaaaacatgaaatacctgaaaaataattcaaactactgatattaaagaagctcagtgagatccaagagaacacagacaaacacaaggacataagaaaaacaattcatgatctgaatgagaaatttaacaaagagatatcattttaaaaaatcaaacagaaatcctgcatctgaagagttctatgaatgaaataaaaaatacaattgagagcttcagaaacagactagatcggggtgtccaatcttttggcttccctaagccacactggaagaattgtcttgggccacacataaaatacagtaacactaatgacagctgatgagctaaaaaaaaaaaaaaaaaaaaaaatcatgttttaagaaagtttacagctgggcgcggtggctcatgcctgtaatcccagcactttgggagactgaggtgggtggatcacctgaggtcaggagtttgagactagcctggacaacatggtgaaaccatgtctctactaaaagtacaaaaattaactaggcatggttgcgcatgcctataatctcagctacttgggaggctgaggcaggagaatcacttgaacccgggaggcagaggttgcggtgcgccaagatcgctccactgcactccagtctgggcaacagagtctcactctgtcttaaaagaaacaaaaaaaaaaaaaaaaaaaagaaaagaagtttacgaatttgtgttagaccacattcaaactgtcctaggctgcataaggcccatggatcacaggttagacaagcttgaattagatcttttatttatttactttccaagatgacagataagagtcagtgttagcatgcctctcccacttggaaggaaagaatagtggctagagagtcacactgtgaattttcttttttccaagaaccaccacaggaagatggaaggaatccacaaaccctctgaaagaagcagcaggctggagcctactgcatgagacaggtgaaaaactaagttcccagagtgtaagcaggggaatgagcctgtctcggagcacacatccccacctgcaagtctgaaaatccagaccatgggagaaagccttaaccctaccgagagctggaatggatttagtctatgtgaaatacaaaagtagacgcagcagcatgaagtgccttgtaggcattcccagtctccagcatgaacagaggcaagccattcctgactgcatctcataggggccctcgaagaagcagtcaatgagttcagggaggggtcatagggtgaaagaagctcccagatgaattttgcgatataatcttgagtagggatgagctctcctgaacagaacccacagggtgagtgtaaagtgtgctacagacatgagcagaggagctgggcgtccggccttatgggcatatggagaaaggcatggttatggccttgggcaggtctgagttccgtgcgcagactgcctggaactaaatccagtaagcgaagcactgtgggagtgagaccagcgtcgccaactgtgaaagagctgggtgaggctcattgttgcccactactctccactccctttgggaactcttctatgcagcagatgcagttaactaccctctggaacattatcccaggagcctgaggtctcaaagaagttctgaaagaagttctgaatcttgaaacaaaagctctgaaatgcacctatatagaacctcctgaaagcataaatctcacagggcctaaaaaacaacaacagaatgaaaaaaaaacaaagtatctaagtaacaactaacatgatgaatagaacagtacctaacatttcaatattaacgttgaatgtaaatggcctaaatgttccacttaaaagatacagaatgacagaatggataaaaaaccaccaagtatctgctgtcatcaagagactcacctaacatataaggactcataaaaatttaaggtaaaggggtggaaaaagacattccatataaatggaaaccaaaagcgagcagtagttattcttatatcagacaaaacagactttaaagcaacaacagtaaaaaagacaaagaaggatgttatacaatgataaaaggattagcccaacataaggatactataatcctaaatttatatgcaactaacactggagctcccagatttataaaacaattactattagatctaagaaatgagactggcaacaacacaataatagtgtgggacttcaatactccactgacagcactagaaagatcaagacaaaaagtcaacaaagaaacaacaaacttaaactatatcctagaacaaatgaacttaacaggtgtttacacaacattcttcccaacaactgcagaatatacattctcctcatcagcacatggaacagtctccaagataggtgatatgatgggccacaaaataagtctcaataaatttaagaaaatcaaaatcctatcaagtatcttctcagaccacagtggaataaagctggaaatcaactataaaaggaactctcaaaattatacaaatacatggaaattaaataatctgctcttgtataatttttgggttaacaatgaaatcaatatgtaaatttaaaaattctttgaaatgaataatagtgacacaacttatcaaaacctctgggatacagcaaaagcagtgctaagaggaaagttcacagtgttaaatgtctacatcaaaaaccctgaaatagcacagacaatttaatgtcacatcacaaagaaatagagaaacaagaacaaactaaacccaaacccaggagaagaagtaacaaagatcagagcagaattaaatgaaattgaaacaaacaaaaaaacaaaaaatacaaaagataaatgaaacaaaaagctggttctttgaaaagataaacaaaattgatagaccattagtgagattaaccaagaagacagaagatccaaataagctcaattcacggtggctcatgcccacaatcccagcattttgggaggccaaggcaggcatatcacttgaggtcaggagtttgtgaccagcctggacaacatggtgaaaccctctctctactaaaaatacaaaaatcagccaggcatggtggcaggcgcctgtaatcccagccacttgggaggctgaggaaggagaattgcttgaacttgggaggcagaggttgcagtgagccaagatcacaccactgcactccagcctgggtgacacagcaagactgtctcaaaaaaaaaaaaaaaaaaaaaaaaaaaagaaagaaagaaaaaaaaaagaaactggagatattgtaactgataccacagaaatacaaaaggtcattcaaggctactatgaacacctttatgtgcacaaactacaaaatctagaggaggtagataagttcctggaaatatataacccttctagattaaatcaggaagaaatagaaaccctgaacagaccaataacaagcagtgagactgaatcagcaattttttaaattgccaacaaaaaaaagtccaggaccaggtggattcacagctgaattctatcagacattcaaagaagaattattaccaatcctactaaaattattccaaaagacagaaaaagaggaaatcctccctaaatcattccatgaggccagtattaccctaataccaaaactaggaaaggacataacaaaaaaagaaaactacagaccaatatcctgatgaacatagatgcaaaaatcctcaataaaatactagctaaccaaatccaacagcatgtcaaaaagataatacatcatgatcaagtgggtttcaaactagggatgcagggatggtttaacatatgcaagtcaataaacatgctacataacagaaacagaattaaaaacaaaaaccatatgatcatctcaacagagatggaaaaagcatatggtaaaatccagcatctctgctgggcagagtggcttatgcctataatcccagcactttgggaggctgagacaggcagaccacctgaggtcaggaatttgagaccagcctggtcaatatggtgaaaccccatctctactaaaaatacaaaaattagcatgcctgtaatcccagctactcagaaggctgaggcaggagaatcgcttgaacctggaaagtggaggctgcagtgagccagatcgcaccactgcattccagtctgggaaagagagtcaggctctgtctttaaaaaaaaaaacaaaaaaaacagcatctctttatgattaaaaaccctcgggctgggcgcagtggctcacacctataatcccagcactttgggaggccaaggtgggtggatcacgaggtcaggagattgagaccatcctggccaacacggtgaaaccctgtctctactgaaaatacaaaaaattagctgggcgtggtggcgggtgcctgtagacccagctcttccggaggctgaggcaggagaatggcgtgaacctgggaggtggagcttgcagtgagccgagatcacaccactgcactccagcctgggcgacagagcgagactccatctcaaaaaaaaaaaaacaaaaaaaccctcaacaaactaggcaaagaagagacttacctcgaagtaataaaaaccatatatgacaaatccacagccaacatcatgttgaatggggaaaagttgaaagcattcccgttgagaactggaacaagacaaagatgcccactttcaccacttctattcaacatagtactcagccagagcaatcagacaagagaaagaaatgaagaaaatccatattgcaaaagaggaacccaaactgtcactgtttgccagtgatatgatcgtataccttagaaaaccctgaagactccatcctggctaacatggtgaaaccctgtctctactaaatatacaaaaaaaattagccaggcatggtggcaggcgcctgtagtcccagctccttgggaggctgaggcaggagaatggtgtgaacctgggaggtggagcttgcagtgagccgagatcgtgccactgcactccagcctggggtgacagagcgagactccatcttaaaaaaaaaaaaaagaaaaaaaaagaaaaccctgaagactcatccaaaaagctcctagattggataaataaatttggtaaagtatcaaagtacaaaatcagtgtacacacatcagtagcactgctacacaccaacaatgaccaagctgagaatcaaatcaaatttaaaaactcaaccacttttacaacagctgcaaaaacaaacaaacaaacaaaaacttaggaatatacttaaccaaggaggtgaaggccctctacaaggaaaactacaaaacactgctgaaagaaatcacagatgacacaaacaaatggaaaacacatcccatgttcatggatgggtagaatcaatattgtgaaaatgaccatactgccagacgcaatctacaaattcaacgcaattcccatcaagataccaccataattcttcacagaactagaaaaaacaatcctaaaattcatatgaaaccaaaaaagagcccacatagccaaagcaagactaaggaaaaagaacaaatctggaggctttacattatctgacttcaaactatactgttaggccacagtcaccaaaacaacatggtactggtataaaaataggcacacagatcaatggaacagaacagagaactcagaaataaagccaaatacttacagtcaactgatctttgacaaaacaaacaaaaacataaagtggggaaaggacatcctaattggcaagccacatgtagaagaatgaaactggatcctcatctctcaccttatacaaaaatcgactcaagatcgatcaaagacttaaatctaagacctgaaaccataaaaattctagaagataacatcagacaaactcttctaaacattggcttaggcaaagaattcatgactaacacccccaaagcaaatgcaacaaagacaaaaataaataaatgggacctaattaaactaaaaagcttccgtagagcaaaagaaataatcagcagagtaaacagacaacccacagagtgggagaaaatattcacaaattatgtatctgacaaaggactaatatccagaatctacaagaaactcaaacaaatcagcaagaaaaaaacaaatagtcccatcaaaaagtgggcaaaggacatggatagacaattctcaaataagatgtacaaacagccaacaaacatatgaaaaaaatgcttaacatcactaatcatcagagaaatgcaaattaaaaccataatgagataccactttactcctgcaagaatggccataattaaaaagtcaaaaaacaatagatgttggcatggctgtgttgagaagggaacactttcacaatgctggtgggaatgtaaattagtacaaccactattgaaaacaatatggagattccttaaaaaactaaaagcagggccgggcacggcggctcacacctgtaatcccagcactttgggagttcgaggagggtagattacctgaggtcaggagtttgagcccagcctggccaatatggtgaaaccctgtctctactaaaaatacaaaaattagccaggcatggtggcacacgcctgtagtcccagctactcaggaggctgaggcaggagaatggcgtgcacctgggaggcggagcttgcagtgagccgagactgcaccactgcactccagcctgggtgacagagcgagactccgtctcaaaaaaaaaaaaaaaaaaaaaaaaactaaaagcaggactaccattcgatccagcaatcccaccactagatatctaccccaaggaaaataaatcattatatgaaaaagagacatgcacacacatgtttataacagcacaattagcaactgcaaaaatatggaaccagcccaaatgcccatcaaccaactagtgcataaagaaaatgtgaatcctactcagtcataaaaaagaacaaaataatagcattcgcagcaacctggatggagttggagtccatcattctaagtgaagtaacctaggaacagaaaaccaagcattgtatgttctcatttataagtgggagctaagctatgaggatgcaaaggcataagaatgatataatagactttagggactctttggggtaaggttgtggggctgagggaataaaagactacattttgggtacagtgtacactgcttgggtgaggagtgcactaaaacctcagaaatcaccactaaatagctcatccatgtaaccaaaaaccacctgtgacccaaaaactattgaaataaaatttaaaaaatatacagactagatctagcagaataaagaatttcagaacttcagctactcaagagactaaggcaggaggatcccttgagcctcccaggaggtggaggctgcagtaagctatgatcactccactgcactccagcctgggtgacagagtgagaccctgtctcaaaacaaacaatgacaataaaatggaggaggaataaaaaaaaaaaaatgaagaaagcctaactgactttgggacagcataaactggccaaatatttgcattttgggtgttgtagagggagaagggatgggtaaaggaaaagaaaatctatttaacaacatagtagctaaaaacttctcaaatcttgcaaaagatatacacatacagatacaggaagctcaaaattctgcaaatagattgaatcccaaaaggtcttcaccaaggcacattatactcaaactatcaaaaggcaaagaaagagataaaattctaaaaacaggagaaaggcctaaagttacatagaagggaagcttcctttagactaacagtgtatctctcagcaggatcattacaggccaggagagaatgcaatgatatatttaaagtgctgaaagaaaaaaacctgtcagccaagaatattattcccagaaaagctatccttcaaaaatgaaggagaaataaagtcttctcagacaagtaaaaactgaaggaattcattactgctagaccagccctccaaaaaatgcttaaggaagttctacatctggaagcaaaaagacagtatctaccatcatgtgaaaacacataaaagtataaaactcactggtagaacagacatacaaacgagagagagagaaaaaactcaaatgttaccactacagaaaaccactaaaccacaatgataaacaatgagagaaaggaacaaaggatatataaaacaaccagaactcaactaataaaatgacaggaataagcccttacatatcaataataataaccttgaatgtaaatagattatccacttaaaagacaaataatagcttaatggataaaaaagtatggcccaactatatgctgcctacaagaacctcacttcacttgtaaaaacacatacagactaaaagtgaaaaaatggaaaaagatactccacacaaatggaaaccaaaagtgagggggagtagctatacttagatcaaagagattttaagtcaagaacagtaaaaaaggacaaaggaggccattacataatgataaagggatcaattcagaaagaggatataataattctaaatatatatgtacccaacactagagcatccagattaaagcaaatattatcaatctaaagagagagacaccaacacaatagtagtcaaggacttcaacagcccactctcaacagaaaagataaatgaaactgataaatggctagctagactaaccaagattggaaacaaaaaaaggaggcattataactgataccacagaaatataaatgatcatcagagactattaaaacagaacaactatacactaacaaactgaaaagcctaaaggaaatgaataaattcctggacatatacaacctacgttgattgaaccaggaaaaaaacaaacaaacaaacaaacaaaaaaaccagaaaatctgaatagaccaataacacataacaagattgaatcagtaataaaaaggctcccaaaagagaaaagctgcagaccagatggctttcctgctaaattctaccaaacttataaagaagaattaacatcaattcttttcaaactattccaaaaacctcaagagggaagaattgttcctaactcattctgtgagaacagtattaccctaatactaaaaccagacaaggacacaacaaaaaagaaaactacaggccaatatccctgatgaacagacacaaaaatccttaacaaaatactagcaaactgaattgaacaacacatcaaaagtcccactagatcataatacaccctgatcaagtgggatttatctcagagatatgagaatggctcaacatgtgcaaaccaatgagtgtgatacatcacatcaacagaatgaagcacaaatatcatactatcatctcaatagatgcagaaaaggcatttgataaaattcaacattctgtcatgataaaaaaaactctcaacaggccaggcgcagcagctcacgcctataatcccagcactttgggaggctgaggcaggcggatcacctgagattgggagtacgagaccagcctgaccaacatggagaaaccccatctctactaaaaatacaaaaattagccaggcgtggtggcgcatgcctgtaatcccagctactcaggagactgaggcaggagaatcacttgaatctgggaggcagaggttgcggtgagctgagattgtgccattggactccagcctgggcaataagtgcaaaactccatctcaaaaaacaaaaaacaaaaaacctctcaacaaaagaatgtacctcaacataataaaagccacatatgacaaacctgcagctaacatactgaatgaggaaaagctaaaagtctttcaagaattggaacaagacaaagatgcccactttcaccactcctattcaacatagcactggaagtcctagccagagcaatcaggcaagagaaacagaaggcttccaaactggaaatgaggaagtcaaactgtccatctttgcagatgacatgttcttacatagagaaaaacctaaagactccaccaaaaaaaaaaaaaaaaaaaaaccttagaactaatagacaaattcagtaaagttgcaggatacaaaacaaacacaaaaatcagtagtgtttctatacaccaataatgaactagctaaagaagaaatcaagaagtcaatcccatttataatagctataaaaaaaataaaatatctggaaataaatttaaccaaggaagcaaaagacctctataaggaaaactacagtacactattaaaagcaattgaagagaatatgatatagtttggctgtgtccccacccaaatctcatcttgaattgtagctcccataattcccacatattacaggagggacctggtgggagataattgaatcatgggggcggtttcctccatactgctcttgtaacagtgaataaattctcatgagatccaatggttttataagggaaaacccctttagtttggctctctgattctctcttgccaccgccatttaagaagtgccgtttgtcttctgccatgattgtgaggcctcctcaggcatgttgaactgtgagtccattaaaccactcttactttataaattacccagtgtcaggtatgtctttgtcagcagcatgaaaacagactagtacaggatacaaatagaaagacatcccttgtgcacaaatcagaagaattaacattataaaataaccataatacccaaagcaatctacgaatacaatgtaattcctaccaaaataccaataacattcctcacagaaatagagaaagcaatcctaggccaggtacagtggctcacacctgtaaccctagcactttgggaggctgaggcaggtggatcatttgaggtcaggagttcaagaccagcctacctggtgaaactcttgtttctaccaaaaaacaaaaataaataaataaataaataaaaattagctgggtgtggtagtgtgcacctgtaatcccagctacttgggaggctgaggcacaagaatcacttgaactcgggaggccaaggttgcagtgagctgagactgcaccactgcactcaagcctgagtgacagagtgagacattgtctcaaaaaaagaaaaaaagaaagaaagaaaccctaaaattagtacaaaaccacaagagtccgaatagccaaagcaatactgaaccaaaataataaagctggaaacatcatactacctcacttcaaaatatactacaaagctacagtaaccaaaataacatgatattggtatttaaaaagacatggaccagtggaacagaacagatgcatggaaatctaggtatttatagccactgattttcaacaaaagcaccaagaacacacaatggggaaaggacaccctcttcaataaatggtgctgggaaaattggatatccatatgcacaagaataaaactagactcctatctttcatcatagaaaaatcagctcaagacggattaatgacttaaacataatacccaaaactataaaactactatagggaaacataggaaaaacactctaggacatccaggcaaagattttacggctaggacctcaaaagcacagggaacaaaaacagacaaatgggattacatcaaactaaaaagtttctgcacagcaaaggaaacaatcaacagagtaatgagacacctgttgaatgggagaaactatatgcaaactattcatccaatgggggactagtatccaatatacacaagaagctcaaataactcaacagcaaagaaaaaaaaatcctgttaaaaagaaggtaaaggatctgaatagacatttctcaaaagaagacatgcaaatagccaaaagatatatgaaaagatgctcaacataactaaacatcagggaaatgcaaatcaaaatcacaatgagttatcaacttaccccagttaagatatgactactatcaaaaagataaaaaataacaaatgctggtgaggatgtgaagaaaagggaacttttagacattgttggtcagaatgtaaattagtatagctacaatggaaaacaatatggaggttcctcaaaaaaaaactaaaaatagaattaccatatgctccaccattcctgccactgggtattcatccaaaggaaacaaaatcagtatatctaggcaatatccacatccccatttttattacagcactattcacaatagcctagatacggaatcaacctaagtgtccatcaacagatgaatgaataaagaaaagtggtgtatatacacaatggaatactattccatcataaaaaagaaaatccggtcatttgcagcaacaaggatggaactggcattaggttaagtgaaataagccagggacagaaagacaaaaagaaaaaaaaaaaatctcatgttctcactcacatgtgagaactaaaaaaattgatctcatggaggtagagagtagaatgatagttaccagaggctgggaagggtatgtgcggagcggggaagggagtatggagaggatgcagagaagttagttgggggtggggcaggggtttaaaaaagaattatttgggtaaagacatacagttagatagaagaataagacccagtgcttgatagcacagtaaggtgacaatgattaaaaataatatgtcatatatttcaaaatagctagaagagaagatctgaaatgttcccagcacaaagaaacaataaatatttaaggtaatggatatcttaaatacctgttttgatcattacacattgtatatatgtatcaaaatatcacatgtaccccataaatatgtacaaatattatgtaccaatttaaaaaaaatttaaggaaagtgagaatgagagaaaatatctgcaaatcatatatctgataagggactagcgtccagaatacataaagaaccagtataactcaacaataaaaagacaaatacctccctcaaaaaacaaaggatctgaatagatacttctccaaagaagatatacagatggccaataagcacatgaaacgatgctcaacattgttagccattacagaaattcaatttaaaatcacaataagataccactttatacctactaggttgataaaagagcagacagtaacaagagttggtgagggcataaagaactggaacccctacacactgagggaggaatgtaaatggtgcaggcactttagaaaacagtctggcagttcctcaaaagctacataaagagttgccacatgactcagcagttccatttgtgggtatacatactctggagaactggaaacatatccgtacaggaacttgtacatgaatgttcacagcagcatcattcgtagtagccaaaatgagtaaaatgtcattgagtaaaatgtctgtacattctagtgttaacaagtgacaagaagaaaagtttttttaaaaagtctgtatactcatgaatatataaatatataaaatacatagtatatgtccatacaatggaatattattttgcaataaaaagaaatgaagtactgatacatactacaacataaatgaactttgaaagcattatgctaattgaaagaagctgatcacaagggaccacataccacatgattcaatttatatgaaatgtccagaatagtcaggtctatagagatagaaagtacattagtggccgcctaggaccagggaagcaagatgagagactggaaataatggctaaggagtgttgggtttcttttcagaataataaaccatttttaaaattgattatcatgatgttgcataactctgtgaataaactaaagccactgagttgtacaccttaagtgggtgaactgtatggtatatgaattatatcttgataaagccatttataaagagtgtcaaagataatgatgtaatagattcagtataatgaatgagagtaaataaaacaaatttcaaaagcctgcaatgtcagcactttgggaggccaaggcaggaggatcacttgaggccaggagttagagaccagcctaggcaatatagaaagaccccacctctaccagaaaaaaaaaacaaaacaaaactcaataccaaggatgaaagaaaaactaagggagtttactacccacagacttttaaagtatctacagaggcacttcagcaagaataaaagtgaacacagaaaaaaaggtataaaattcaagaaacaacttacaaaatttgggaattttgattcataaatgtaattaatcattgagtacaaaaaaagtagtaaccataaattggtggtttttttttgttttttttgagacggagtctcactctgtcgcccaggctggagtgcagtggcgcgatctcggctcactgacagctccgcctcccaggttcacgccattcttctgcctcagcctcccaagtagctgggactacaggcgcccaccactgcgcccggctaatttttcgtatttttagtagagacggggtttcaccatggtctcaatctcctgagctcgtgatccgcccacctcggcctcccaaagtgctgggattacaggcgtgagccactgcgcccagcccgtaaattgtgttttttaacaataaggaaaattgaggtcaggagttcaagaccagcctgaccaacatggtgaatccctgtatctacttaaaacacaaaattagctgggtgtggtggcacatgcctataatcccagctacttgggaggctgaggcaggagaatcgcttgaacccaggaggcggacagtgcagtgaaccaagatcgcgccattgcactccagcctgggcaacaagagagaaactccgtctcaaaaaaaaataataaataataataataataaataaaataaattagctgggcatggtggcttgcacctatagtcccagctacttgagaggctgaggtgggaggactgcttgagcctgggaggtcaagactgcagtgaggctgtaattgcaccactgtactacagcctgggtgacagagcgagactatgtctcaataaaataaaaattaaaattaaataaaatttataggaaacacaaatggaacagaaacacagtatacagtttccaaactgagaaagagaaaaataagaggaaaaagaaaattcactcaacacaatggaaggcaataaaaggaaaacggtaaaacaaaacaaaacaaaacaacaacaacaacaacaaaaaaaaccaacaacaacaaaaacttctatatagtatttggaaactaaaaaatagagctgaactatgaaagttctacatgtcaatgcttgtggtatgtagctaaatcaggacttagagataaatgtgtagccttaaatgaatttattaaaaaataagacaaacaaatgaattaagtgctcaattcaagaagctaaaaataacgggaacctcacaaaaacaggaggatcataataaagattagaaatcaaggaaccagaaaacaaacaaacaaaaaaattagagaaggcaacaaaactaaaagctgactctctgaaaagactaaaaaaaaaaaaacaaaaacaaaaacaacctaggctggtgcagtagctcatgcctgtaatcctagcacttttggaggccaaggcaggagaagcacttgagcccaggagttccagaccagcctgggtaacatagtgggactccatcgctacaaaaaaaaattttttaactagccaggcatggtgacacatgcctgaagtcccagctactcaggaggttgaggctggaagatcacttgagcccaagagattgaggtggcaatgagccatgatcataccactgcagttcagcctgggtggcttcagcctgcctcaaaaaaaaaaaggaacctagaacaagatgtcaagaaaaaaaggaacaatctaagttagtccccctgtaaaggaatggatagtggaatattcataaactagaatactatatacaatagctaaatgaatagagagctctgcgtgtacacaacgttgatggagaaaaaagttacaaaatgatatgatcagtatgatacaatttatataaaaacttaaatcccatacattgtttatggatatgtatctataaattaagtataaaaacatgaatagcaaggatttacacagcttgaggatcctggttatacttctgaggtaagagagggagtggaatggaatagtggaagacacaaagaaagtttcaactatatctgaacattttagttcctaaaaaggtctgaaacaagtatgacaaaatgtgattaacacttaaatatgggtggtgggaacagagatgttcattatgttgcattctttattttctatatttctttcaaatatgtgaaatatttcgaagaataaaataatcacactgccctatgtatgcagaatgaaatggaagagagcaagagtgaaacaagaagaccttctaagagagcatttgtagaaatcctggctagagtgatggtaacctagaatagagatgacaataacaaaatgaagagaagtcaacgaatgtgagattatattaagaacaatttatgggacttattgatggactgggtatgaggagcttgacagaagaaggaatcaaggttaacttcagctaaagcaacatgtaggcatagatgccacttactcaaacagggaaaggtggcaaaggaaccagttagggggcatgaaagaatcctgttttatgttcatcttttatttctcctactcagacataagctctttatggggagaatctgtctgctttatctttgtatcccccaaagttcataatgtaactaagttgaatcaatgttatacacactgcctagttttgaaaaacagacaaccctctttaaaagcgtcagttttcgctctctcctctctcctctctctcccctctccccacggtctccctctgatgccgagccgaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcactgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgctacaacctccacctcccagcagcctgccttggcctcccaaagtgccgagattgcagcctctgcccggccgccaccccgtctgggaagtgaggagcgtctctgcctggccgcctatcgtctgggatgtgaggagcccctctgcccggctgcccagtctggaaagtgaggagcgtctctgcccagccgccatcccatctaggaagtgaggagcgcctcttcccggccgccatcccatctaggaagtgaggagcgtctctgcccggccgcccatcgtctgagatgtggggagcgcctctgcccggccacgaccccatctaggaagtgaggagcgtctctgcccggccgccccgtctgagaagtgaggagaccctccgcctggcaaccgccccatctgagaaatgaggagcccctccgcccggcaaccacaccgtctgggaagtgaggagcgtctccgcccggccagccgccccgtctgggagggaggtggggggtggggtcagcccccctcccggccagccgccccgtctcggagggaggtgggggtcagccccccgcccagccagccgccccgtccgggagggaggtgggggggtcagcccccctcccggccagccgccccatctcagagggaggtgggggggtcagccccccgcccggccagccgccccgtccgggaggtgaggggcgcctctgcccggccgcccctactgggaagtgaggagcccctctgcacggccagccgccccgtccgggagggaggtgggggggtcagccccccgcccagccagccgccccgtccgggagggaggtgggggtgtcagccccccacccggccagccaccccgtccgggagggaggtgggggggtcagccccccgcccggtcagctgccccatctgggaggtgaggggcgcctctgcctggccgcccctactgggaagtgaggagccccactgcccggccagccgccccatccgggagggaggtgggggggtcagccccccgcccagccagccgccccgtccgggagggaggtgggggggtcagccccccgcccggccagccgccccgtccgggagggaggtgggggggtcagccccccgcccgaccagccgccccgtccgggagggaggtgggggggtcagccccccgcccgaacagccacccagtccgggaggtgaggggcgcctctgcccggccgcccctactgggaagtgaggagcccctctgcccggccgccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggaaacttttcattttgttctgtactaagaaaaattcttcggccttgggatcctgttgatctgtgaccttacccccaaccctgtgctctctgaaacatgtgctgtgtccactcagggttaaatggattaagggtggtgcaagatgtgctttgttaaacagatgcttgaaggcagcgtgctcgttgagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaaaaaaaaaaggaaaaaaaaaaaagtgtcagttttcaaagacattttatatcacttaatattacaataaaggaaaaaaaactttcaagaggttcccacaaaagttttcctatgctgctgattcagacttttaaggcccatagaaatttatgctttccactttcttactaagccattttaatcagtttcatatgattctaccagttcggtagattataaggtatacaatactataatgtatactattataaatgggatgcaatttataatagggttattattatacaatatatccttataaactactagtcatgtattgttttggttatatagtttatacagccccttatgtggcttggttatactaccacctagataagtaggcaagacattctgtaatatttagtgcagagctggaattcacgcctaaagcatcaggcggcaaatccagaattcgtcattttactaataatgaaactgatgcttgaagaagtcaggtgacttggccaaagatataaagctaataactgtaggctaattttgctctccttaaggaactgatgctattctaagcttgttaacattatgaaaatgcataatgaaaaaactcaaaatttatccaaaagacagattctaattcttttgcttacttttgaagtctgaatcatatgatacagaagattcttccactaatactacataatcagaacagtgaaagtaaaatcacatttcaaagggtcattaactaagtgtgttttccctacgataaaacggtaaccaagtttctttagagggaaattaactgtatctaaaaagtaatacttgagtatatcataataccacaagtttcaattactgtttttttgttattcaaaaccaaaacaagtatatgtcaaccactgcatattggcaactacccctttttagtgaaccatgaaaactgaggagtgttaggtcctaggtcaatttttaatgtcaaacacaataagtgatgtgattttagtcaacttcagagtagctttatgcttatacttccccccctctcagtttatcccattagcttaggatatttggggaaggtggaggaacatattaaagagtagttcagaattcaacaaagtactcaaagctttaagtataaatatcccatataaataaatccgggatttaactgttttatcctaacagtttagaaatgtcattttaagtgccaaaaggaaattccaaaaggactcttagaaaaactgttataaatttttaaatgtgagaatacagtcatttgaaaatatacataatccacatttttagcaatgctagttctgctgctggatttacataaatttgtttgtgtcaagtttatttctccctgttgtatgggatacatataaatggaaacaaaactgagttcaaaggcataatgagtatacttatttcttcttaaattcaatatatttttatttgattttagaaataatgagaaaccaatgatggttactgcaccaggtgtgacactatgagagaatgctttaatagtatagctttggctgtaatgcaaagaatagatagtacaatgacagagataggagggtattagaagttagagatgggtatgtgttataatagtctgggtcaggcaagaactttataaaagctcagattccggggtaacacccctggaattctgagtcaatgggtgtaaagctagtcctcttaattctagatgaaatgctaaacatgaatgactggtaggaagttaaagcatcaaagggagaatatccttgatgctgacccttttagaagaatatcagaaacccataaaaattataagcagatgcttcatttttaccacaaatggatactgactcacctggatcagggtcatattttaggtccagtggatgtacaacagggtggtactgcttctaaacataacataaattaaaacagatttaatcacttaatgcttcatataaacatctctttcagctaatatgggagatatactatagagtcagtaccattcttttgaggaaaaaaaattaaatcctactgtctgtagggaagaggaggtgagaaggtaaaaccaaactaagtctgaattatgtcttttacagtactgccacctgctgcatatactaagaagtggcaccataaaaaagtataatcagaaaaagcaatcaagcaaattaaaagcatagaaactgaattttatgtttaaagtacagggtagtctccaattatgaagggactgtgtttcaaaagttcattcaggacaagtgtttagaactcaaaatgcatatttccatgaaaactcagttctaaaaggtggcgaggctacattaccaccacactaagcctatatatcctgcgacacactgaaattatagtagcagaattactggcacagaatctacaatgcaggcaaaaagaaagaggaaattgctcttccttattcttgcccaaagccagcagaagccaaaaaggttaaaagaaagaaaacaagaagaaaaaaaggtcttcagccagctgtggtgactcacacttgtaattgcagcactttgggaggcccaggcaggagaatgtcttttgctcaggagtctgagaccagtctgagcaacaaggagggaagaagggaggaaagacgcagggcagggcagggcaggaaaaaattttgaaaaggtctttggtatcctcaccttatctattttgcattactttttaaactaccacagcagtacctcacctaggccagccatctttcttttctgcaatattgattactagttttgggggtttaggggtagtggggcagtaacaagggcaacactgaaaaatacactttcaatgtttttcctgaaaaaaactttcaagtgggaggggtgggggaagtgatggaatgcggtatttgagaactgctataaagaaaattaaaaattctgctcatgaatactgtttttcacagaataactaaaatgttttagatacaatattaagccgggcatataatgacctgaaacaatcctgaaactgaggcaactagaagatttatatgtgaacatttatgtactaatttcaaaaactaaaggcaatagtatagcacaatctaaacacaacatgtacctcactggagggacaatgctattcccagcaaacctcccctccccaccaagggaagatttgggtccaattttcttgtggatttcctattttttatttattctagtcctaataaatctgaaaagatgagggtgtgatatggttggtcattgatatctatagtaattataagaaggaagtctacggctctgcttgtctaaaaagctcgtgctgaaggagctgaattcctggtcttgtcacccagatgttcatgatttttgcagcaaaacaaattacacccaattcataaagcaaatttcagtgttatgaacaggtactaaaacaatcttcatcatcaatttaactaaatggtcttccaaaatatacaaacatacaaatatatgccaaaaaaaaacaacaaacagaaagaaaagtgttaaaagaaaagcttctttttccatccttgtctcagaatcataaagtcattgtcagtcttccatcaccaatttcaattttaaccactcactataactttcatttttttcatttttgaaccagtgtgttcaaaacacagtatagtatgactatactatgtcatagtacaacttagaagagtaaagtcttacaagagacaaacaatactaattgaggcaggaaagaaaaagacaacaaaatgtcacttatctccacgtagagccttatattttaatgtttttattgtggtaaaatatactataacattttaaaggcaaatcatcttaccagaatttcttgttttgcttttatggttttgatgacacattccaggatctttctgggatactgcttacgttttgtggctatatctactatgatttcatcaaactgatcttcaagtactttgatgtcagaatctatttgagaaaaaaaaatgtatatataaaaagttccctaaaactcattgtttacattctgtatggaaatgtgctataaactaaatttagaaaacacaaaataatgaaggaaaacaaatatggcaagttaatgaatgcccccactttggtgattaatttatttacgcattgaacaatcaattattgagcatctataagaagccaggcctaaacaagagaaatacaaagatgagcacaacatgattcctactctctaagagttcacagtttgctgaaagaaacagacaattgcaaggcaacctgataagtgcaatagaggtatgagcaaaatgccatcaggacacagaacaatggaaaactgactgactgtgaaatataagactttaaagaagtaacatttgagcttgaaatagaagtataagtccaatggataaaaagtggtacgggaaaaaaggaatagggagaagcattttaggcagtggaaacagtatttgcaagatcctagtctttggagacctgagaaaagttctaaatggctacagaataaagtaaaggagaaatggatgataaaatatataagaaccaggctgtaaagggtatttaatatcagggatgctaagaagttttgacttattatgaactgacccaaagctatgacagtagcagtgagtggagtaactagatctgaaataggactcaactggattgatggtaggaaaaactgaaagatacagtgagtttagagtttctttcatttagctaactctactttatcatatgctttttcatgttttaaaacagtgattctcaaatgttagaagaatcacctaacgagtatgttaggagtacagattttttttttaatactttaagttctagggtacatgtacacaatgtgcaggtgtgttacatatgtatacatgtgccatgtcggtgtgctgcacccattaactcgtcatttacattagatatatctcctaatgctatccctccccactcccccgaccccacaacaggctccagtgtgtgatgttccccaacctgtttccaagtgttcccattgttcaattcccacctatgagtgagaacatgcggtgtttggttttcaggagtacagaattttgattcagtaagtctgagatggggcccagaaatgaagcaccctagatgaaaggaatgtaggtgatccatctaactttattttgaaaatcattttaaagagtaaaaatactaagtagttacaaatactaaagagctaagttcttagcttaactggtcctcatattgctctgttgtgtcaaagtctaagctagaaatggacctatttattttattgatcagaagctttattaggaagaaatctaacatctgaaacataatttttgaaacattttgagaaattgctgatatgtttcggtatatacatatcagataatcaagtatatcaggtatagtctttcattcatgtcacaaatattaattgaatcccactaaattagttcttttgagggcaccctttttttcctttttctctttctttccttccttctttctttccctttccttcccattcattctccctcccttcctttccttcttttctttcctttcctccctccttctttcctagatagatagatagagagagagacacacacagattgattttcaatagcttttggggtacaagtggtatttggttacatggatgaatagtacagtggtgaagtctgagattttagtgcactcatcacccagtagtatacattgtgaaagtacccttcttttgagggcaagaaataatagttatttcttactttgaataattatttatataagcagccctccctaaattttcatttatccattaaaaaagttaaataattagcctgaagaaaataatgtactatttcacaattagttaaaaaaaaaaaaaagaaaagtctcccaggtaaatcttttttgtagagaggaacatgctttcttagcactacctagtgataaagctacaattaaaatgtatcacaaaatttgaacagaagccaggcacaggcctgtaatcccaacactttgggaggccaaggcaggcagatcacctgagtttgagagttcgagaccagcctggccaacatggtaaaaccccatctctgttaaaaatacaaaaatgagccaggcgtggtggcaagcacctgtgattccagctacttgggaggctgaggcatgagaactgcttgaacctaggaggtggaggttgcagtgagctgagatcgcgccactgcactccagcctaggtaagagtgaaactctgtctaaaaagaaagaaaagaaaaattgaacaggaaagaattattcattaatttaacatatttcataggtgcctactatgagccaagagttgagaacaaggtcaggagcagtggctcacatatgtaataccagcactttaggagattgaggctaggagtttgagaccagcctgggcaacatgatgaaaccctgtcctctaccaaaaatacaagttagccaggcgtggtggccacatgcctgtaatcccagcaactagggaggctgaggcacaagaatcactttaacctgggagacagaggttgcagtgaactgagactgtgtcattgcactccagcttgggtgacagtgagacttcatctcaaaaaaaaaaaaaaaattgtctttttaaggaaccttctacaaagatgtaacctcatcctttacacggtacttgtataattaataataacttcacacttttaagggtacttcactattcactctagagatcacttacaaaaatacaacttgctttgtaaataattacagaaattccctgggcctcttttgtcatctggagatagctctacagtattttccaataaactattgacaaagaagactattgaagtcataatctcagttctttattactcccctagtaaacaacttcttgaaaataaatgacactaaatatggagattaaaaaacagcattcaaaacaaaattagctgcaaaaataacccagaaattaataatggaaggaaaaagtcacatacccataaaacaattatctgaagcttcctgccatgcttgcccattaatgctgatattctcttgcacagctgattcaaaagtctgcaataaattcacagtagtcaagtcactaaaaataattttaaatactaaattcaaacgttttagcaaaataatacttccagatttgtgacagaggaaataaaagtagcagaatagctaattagtatatctattcttttcaatgaagattccacttcaatcattgattctacctacattttgggtctcatagccattatgctacccaagagaaaatctgatttaaaattttggaatattcttataaacaaacaaaaaaaagtactcctagaatgaaagaaaaaataaaatctaacaaatttaggctcagttgaatctcaggggtataagtactatatatgctgctgaatgactgttgatgttaacaagagggaaaacatacatgcttaaaaataaaattatattttataaagggctgtatttttgagagatgaacacttatgtagcgatgaaatgacatgagatctaagatatgctttaaaatagcaaacgtaggccaggtgcagtggctcacgcctataatcccatcactttgggaagccaaggcaagaggattgcttgaggccagttccagaccagcctaggcaacacactgagacaaccttctctactaaaaaatttaaaaattagccaggcacagtggcacatgcctgtagtcccggctacttgaaaggctgaggctagaggattacttgagcccagtggtttgagaatacagtgagctatgattgccactgtactccagcctgggagacagagggagaagcaactgtaacaaaattttgacaactgttgagtttggtggtggatatatgggtgtccactgtactaaactaattttttgtaaggttgaaaatgttcataatacattaaaagataaagaaccaaaaaacaaaaaacaaaaacaaacaaaaaatagacaaattggacttcatcaaaattttttttaaatgatggactaaaggaattcggcagtacacatttcctattacccaacaatttcacttctagcaatgcatcctaaaggactactctcataaaaactaaagagaatgtgctagaaatgttcatttcagcactgtttgaaatttttaaaattgtgggaaaaaacctaaagtcaaaattagaagagttaaatagacaatattcataccacgcagtacctaaaaaggatgaagacaagctctacgtaacactaacaaataatagacatgtttggtttcaaaaaaggcaggtcaataacaattcatcagcatgacattattaatggagacaaacaaacataaacagagagaaagaggtaaagccacagaaagggggtatagaaagtttactctccccaagtactctccaaaatagtaccttatgtcctagaaggaagagggatggggaaggggaactcaaagaattttgctttatgctactgtttgaatttttttatgagcatatattttgtaccctttgtataattaaaaataacataaaccaaattactgataattatgagttaaagtacatattctacatttcaaagatttcataaagtaaaatccttattttattttttgtttgtttgttttttgttttttttgagatggagtttcactcttgtcaaccaggctggagtgcaatggcgcaatcttggctcactgcaacctccgcttcccaggttcaagcgattctcctgcctcagtctcccgaatagctgggattacaggcaagcgccatcacacccggctaatttttgtatttttagtatagacagggtttcaccgtgttggccaggctggtctggaactcctgacctcaggtgatccgcccgcctcagcctcccaaagtgctgggattacaggcgtaagccatcgcgcccggcctatgtatgttttaaaattattttctagaattactttcaagaattgctgagaaaacatattgtctttgtaacattcattgcagactgctaccaatactgtttttaaagaaaatctgctacttaatatgcagttttaaacagagatacaaaataaagcttctgctttatttaaaataaaacacaagtgaattcctgtggtagtctaagccctgtaaactttatcttataattcactttatcgtcccactaaataggatataataggttaagccaagttcctctttttctgtaagacacctaaatgttttaaataccttagcatttcctagaatcagacaaattctaagattatacaacaaaagtcttctcccaaaaaactactaaaaacgtcctgagatatatccctattcttgccttgcttgcaaggagggaatgacgtaagagtcactatatacaaaactacatacagagtcacaacccaggaagtgtttcttcattcttccactgaaccttttttttttgagatggagtctcgctctgtcacccaggctggagtgcagtggcgagatctgggctcactgcaagctccgcctcccgggttcacgccattctcctgcctcagcctcccgagtagctgggactacaggtgcctgccaccatggccggctaattttttgtattattattattattgttttagtagagacggggtttcaccatgttagccaggatggtctcgatctcctgacctcgtgatccgcccgcctcggcctcccaaagtgctgggattacaggcgtgagccaccgcgcccgaccccttttgcctgttttagagtgaaaacattttctttacaagactaaaataggttaaaaaaaattgtgttggttgaaaactttactaagatcatacatttgcctctataccacatttcccaagcctttcttaaatatttttgcaaagccctgaaggtggtagttttttgggaacacaagaaataaagggattgtgtgcttccttataacaggcaccaatctacttatattagcggaaaaaatttaaaagctcataataccgcacatttgtgagttatgaatgaccacagtgcaaacagtaaaaataaaggttaataggccgggcgaggtggctcacgcctgtaataccagcactttgggagcccaaggcgggcggatcacgaggtcaggagatcgagaccatgctggctaacacggtgaaaccctgtctctactaaaaacacaaaaaaattagccgggcgtggtggcaggcgcctggagtcccagctactcaggaggctgaggcaggagaatggcgtgaacccaggaggcggagcttgcagtgagccgagatcgcgccactgcactccagcctgggcgacagagcgagactctgtctcaaaaaaaaaaaataaaataaaataaataaataaataaaacatgcaaaaggaaagatcaaatgctgcttgggtgaatggctgacttccagaattaccctttccaggagaattcctcattgtctgcggctgcattgtccaacaggtgagccactagccactttgtagttactgagcgcttaaatgtaactagttcgaagatgtgccgtaaatgcagcacaccagatttgaaaagcttagtacgaacaaaagaatgtaaaatatctcattcatttgatattattacatgttaaaataccttggatttattgggttaaacaaaatgtcttatttccattaacttcacctatttcttacttttagtttaaaactacataaagattagcttgccttgtattttcactggacagcgctggtctaagtaattaataagacccagctgacattagcatctatttctttctcctctagcgtttctcgaactggttctacagtagcctggggcaccgttaattctgccaaggcctggcgtgggatctttctgaatcctaagatcctgggtgttgggtaagaggatgatgagtaaagaactggctaactggtcccgtacccactgcgcatctcgcagagcgggctcccgaatctcctccggcagagcgtccccgagcttttgcacgaagcggccgcacagttgtagcatttcggtcacagcccgcttcgaggtgcagcgcacccgaaagtcttctcggggagtggcggagaccaaggcctggctctctgtgccagccgcgagctccttgtcccatggagggtcaaggaccaccaactcaggagaccccgccatttttcgtcggaactgtgggcggggcactctggga

SEQ ID NO: 2207 - DNA, 65646 bp, Homo sapiens; identical to SEQ ID NO: 2206

SEQ ID NO: 2208 - DNA, 22492 bp, Homo sapiens
gtagggagaaaatctccagtgctattatatatttcaaacattacttgtttgcataataaccaaacactgagacagcaggcatcagagtgccatgaagtacaacacaactcccacttccatgcttgaagagctttgtgagagctgtgcctgttgaggcaggggacgtgtactgtggactccaggaatgacacaatgttagccggcagacacctcaaagttcctctgatcccaacagactgggaagtggggtgggtgagtggaaggagctttctcaagatcacacagcgaggaggtgacagaccaaggggccagaagttgggtcccctggatctgggccacctgttctctatacttcgtctcactgacttgcacatatttcgataggcagatgggtcttaggaagccagagggttgtcatgacagcaagggtaaggcatcatgggaggtttgggagaggtcattgaggaatgtcactagcagttcattgtcttttttcacaaccaggtactatcacatatttcaaacatcacagtggctggaagcaacagggcaggaacagacaggtgtcgtcacttaacctggtctttggggaccttgacatcaagaccgacaggtcaaatctttggtctcagggagaagagtgccagctcacccagaaggcagaacagctaacagccatgcccaggagaggcagcagtgggagtcatgaaggaggacggggtcctgtcccagcgtcccagcccagctacccaagtagaaggtggggcggcatcttctatggctgagtcttgggcagtgggtgctctgtcatattgtcaggtttcttcccccagctccacaatgtgaagactgaggtggtccctccaagccccactcagcaaggaggacagggctggtggatcctccagggtcagatggggaaataaaagtgtttcattcttgaaggggaagctgcacttctccacggcacgcctggtggtgccaggggttaccacaaagaggcggcagagccatggcccaccagccacttggcaggctggttgtctggtgaagcttttcagggtttggcacagggcccagtcctcagtcccccccatgtccaccacctccactggtgcccccaggcctgggaggtgtaggaggtgccgggggggcatgtaggtgtgagtgaagaggagtgtgtagtgggtgggtgtgcttgggagcacaggggcatggaccacctgctccaggtactccaggccaggcaccaggcccccctgatgcaggcagccgaagaggagggcaccgagggcgttgaagaggaccacagtgcccttccaaggcacaggctgcgtctgtggactacaaagcaggaccagggggaccaggaggggaatcaggaaccgagcctcctggtggctaaaggcagatagcagggccagaggcatgaagtagaggagaaggagataggacctggggctggacagcaggctccgggcacccagtgccctcaggaggcccatttgtgcagaggcctggaggccgacttgcagccgttgccacgcagcctgcagggcctgggcatgcagcaccccgaagagcaggaagccgttgactgccaggtgagtgagccgcgcgtgcgtgccatgtctcgccaggttttggggattcaggttgtagtgcaagaagttgacaggtgtcaggacaaggttcctggatgtagcggggctggagaaataccagctgtccgtggccacaaacaccgctgctgtgagggctgccccagggagcagcaccagggcctcccgggtcagagacttcaaaccagggtttgtggctccacgagtgccccagaggtagagggggaccacagcaaaggccagaaaggtgggccggttgaagaagccagcagccacaatgcctccaagaagccagctgcgccaccgtggacccggcgccggctccttgcgtgtagggccccacgttacatgggaggataccagcaccagcagccacgtgaagaggagtccctcaatggtgttggagaaggtccttgtgtagaagaccagggtgacgtaggaaccagacagcagggccagggcgttccagcgatccgcccccatcggcggggccaggtggtacacggccccgtccagagcaaaggaaagggcagtgaggaggagtcgaggccccaccagcagcgcatagccgctcaccaggccaggccacggccccagctcctcccagagcctgagcagccagaaggtggaaccagagatcagcagggggaagagcaccgagcggcaggagctgctggggtaaaactcccagggccgcgcggcctgaacgcccaggatgtcctctgcagagagaggcagaggtgagccagtaccaagctcagggatgtagtgggcaaaattctaggagggcaccccacatttcccaccccttggtgtgtgtgccctgcgtaatccctgggactgtgcacgggctggatttttcctcccttccctccctctctccctccttctttcccttccttcccttccttccttcccttccttccccttccttcccttcccctcccctcccttcccttccttccctttacttcccttccttcccctcccctcccttccttcccttcccctcccctcccttcccttccttccctttacttctctttccctcccctcccttcccttccttcccttccttccttcccttcccttccttccccttccttcgcttcgttcatctctgtcacccaggctggagtgcggtggcgagatcacagctctcgctatgttactcaggctgatctcagactcctggcttcaatccattcttccagcacagcctcctaatgtgctgggattacaggtttgagccactgcacctggcccgcaggatggactgtatcctgagattaggttacttatacaggagcactgactgtaaaatagggagactatgcagtgggccggacctaatcacaacaatcttttaataacagagttttcaccagctggacgcagaagtggcagtgagattcaaagcatgagaaggatttgacatgccactgctggcttcaagacggaagaggccattggctaggaatgtgggtggcctctgaaagctaagagcaaggaagccgcaccataggttccacagctgaaatgaactagattctgctagaattagagagcttccagacaagaactcagcccagtccatacgctgatgtccaccttgtgagcagagagcccgtgctgcccttctgatggacagaactgtgaactcacagacgggtgcagtttgagctgctcgtaggattttgaggatttgtcaggagcagcagaagcaagtgcaggggagctcagagtgcagagggcaggaggggcttccccgggagatgaggtggcagtgtgtcctgggaagagtgtgtgggaggcgggcaggtgggggaggcctaacctcttctcagggttccaagatctcaaaagccaaggacaagcacccttgtccttacacctgtcaagcttgacagagccgcatctctgataatgattgttatcaggagatggggggagagaagaggggtaggtgatgagccatcagggttatgtcagaggtgatttatgttagttttgtttacaatacttaaatttttttttttttagacagagtctcactctgtcacgcatgctagagtccagtggcgctatcttggctcactgcaacctctgcctctggggttcaagtgattctcctgcctcagcctccaagtagctgggactacaggcgcccgccactgtgcctggctgatttttgtattttcagtagagatggggtttcgccatgttggccaggatggtcttgaacccctgacctcaggtgatccacccgcctcagcctcctgaagtgctgggattacaggcgtgagccactgcaccctgcctatgatacttaaattttttgtaagaagaatatatccaagtagtacttacataatttaagaaatacttgctgcctgttctgtaaccctgtgccccaacgtcccagagctctgaggggtgggggcgcgggagcagctccactccaagcctcattgttcacagcgtctcttgcttgatcacctgctggctgtttcgagctgatcatacagcctgcggatcattcgggctctttgattctgctacttatttctccagactttcagctgttttatctatctatgttagatgttgaaagggaagcaaaatccaggatcaaatctatctggctgcttttctggttaaaaaacgacgtgagggaaagaagatgagccttttaacttaaaaaacaaattcacctgttgagccctgtggcaaagaaagctgatgcctccaaaatatctattccctcctccttcattagacttttttttttctttttttgagatggagtctcgctctgttgcccaggctgaagtgcagtggcacaatcttggctcactacaacctccacctcctgggttcaagcaattctcctgcctcagcctcccaagtagctgggattacaggcgcctgccaccatgccaggctaatgttttgtatttttaatagagatggggtttcatcattttggccagactggtctcaaactcctgacctcaggtgatccacctgcctcagcctcccagagtgctgggattacaggcgtgagccactgcatctgactcctttgactctttttctgggcacttggtcagatataaagactataatttttagcttcctttgcagctaggtgtggcctcatgatacattctgcccagtgtgatagaaatgagcaaaaagcatgcgcccttcaaaatatgaccttaaagagagaagtaatgcccttctcctttgttggctggaaagactgcctgtaggcttgatggctggagctcaagcagccgtcttgaactatgaggatgaccccacatgcccatcacatctgaaaggcctcaaggcctttgggcgagacggtatgggccaggcaaccagcctcatgatgtgtcccacaccgcctaacagatgagtgagtgtcccaggtctgggttcccttacccctctcttgaatctacagaagagaagtttcatgatctcagatcacagccctatggaagctcttgccaaacactggggaagcctaactctaataaaagtgttcccatgggaagtccaacacagctctcattctgaatgacctgtattgttggtccaagcagggatacatcaaagagactggtggtttattagcattacccagaaggtcagtgtcaccactcgggaaggagatatgaagtccccacttccaagttcttaccccagagagagaggctgctgctctgcttgtggatttactactcatctacccagacatgctactccctccccacaaagtctcccgtcagcttctcaagcagactctgctgcagcttgtctcagccacacatgcggagttttacctgccatcacctcaggggactggaagaactcatctgggtgcacatagcccgtctgcggaaggagacaccacagcactcggagcaggctgagaccaccccaaagcaccctgactgccatcttcagatccagttgttgccaacacaccgggcccaaaacctggaatgatgtcccagctgctacagatgctacgctggatccacagatctgcatctgttgaggataacagttgttggttatcacgatgtaaattataatatattcaactgtctgaacaaactgaaaatggatctgtcatttaataaaaatgacaataataataatagctacttcatactctatgcccactaactgccaggcacgtgacatgcatatttcatttaatcctttccacagtctggagcagtgggtcttaggatccctgttgtacagatggggaaacggaggcctctgctgagtaacttggttacttgctgatcatatttgctaaggagtctgatggttcattttatgtgtccacttgactggcctaagagatacccagatagctggtagaacattatttctggcagtgtctataagggtatttcagggagagattagcctttgttgtggtttttttgtttgtttgttttttgagacgaagtcttgctctgtcacccaggctggagtgcggtggcatgatctgggctcaccgcaacctccacctcccaggttcaagtgattctcctgcctcagcctcctgagaagctgggattacaggcacacgccactacgcccggctaatttttgtatttttagtagagacggggtttcatcatgttggtgaggctggtcttgaactcctgacctcatgatccgcccactttggcctcccaaactcctgggattacaggcgtgagccaccgtgcccagctaagattagcctttgaattggtagactaagaagatcagctgcaccagtgtgggtgggcatgatccaacccattgagggtctgaataaaacagaaaggtggaggaagggtgaatttgcactctcttcagctgggatagccatcttctcctgcctcagacatcggtgctcctggttcttgggtcttcagactctatgtctcacaccagtgtgccccaacccacctccctgaatcaagctctcaggccgtcggactaggactgggagttacactgtaggctcctctgtttctaaggctcccgactcagactgaattcaaccaccagctttcctggttctccagcttgcaggtgtcagattgtgggacttcaccagcccccataattgcatgagctaattttcatagtaaatgataaagccagttccctattgtttctgtttctctggagaatcctgacttatacagggtctaaatatgacatttgctcaatgtgacatttgcaaggaagatcagggtacccaacaaatctgggtcttgcagcccatcctgatcaccagctcctatccacaggccagtatggcaggctgcttcttgcatttctgaaaacttgggaaagtcaacggatgccacccatttccctgcaaaaattacactcaaccccattgtttccagtcactccctccaactttcacacaccctggaacctgccttttggaaggtgatgggaacatttgtaactctatatgatgagaatcctaactccctcaactcaaatatagtattaactgcatctcagaagttttctatgtaactcaaagagcagtgacaatctgagcccatggcatgctggatctgtaagtccacagcatcactgctgaacaggaaagcaagcttgacaacctgcttgtccctcctccagaaatagtgatgttgccctgacttcttgatattttaaattctgaccttaaatagttcttgctctcaggtgtaatgtcaggtggctcacacctataatcccagaactttgggaggctgagatgaaaggatcgcttgaaaccaggaggtcagaccagcctgggcagcaaagtgagatccccatttctacgaaaaaatagctggacacagtggtgtgtgctggtaatcccagctattcaggaggctgagacaagaggatcacttgaacccaggaatttgaggctgcagagagctatgatcacactactgcacttctgcctaggtgacagagcaagaccctgtcaaaaaaaaaaagccaggtgcggtggctcacacctggaatcccagccctttgggaggctgaggcaggcagattgctttaagtcaggagtttgagaccagcctggccaacatggcaaaaacctgtctttaccaaaaaaatacaaaatttagccaggtgtggtggtgtgcacctgtaatcccagctactcgggtggctaaggcatgagaattgcttggacccaggaggtggaggttgtggtgagctgagatcacaccacagcaccctagcctggaggacagagcaagactctgtctcaatcaatcaataaaaagttttttttaaaaagaaaacgttgttaactatagttaccctactctgctatcaaacattagaaattaaatcttctaactgtagtttgtactgtagcttatattctaaactgatttttattcctaatattggtttacttgtgcattcttttttctttctttataatcgtcaccagaattgtgttgattttgcgaatttcttcaaaacatcaacttttgcccttgtttttaatttctttgctcatctttattttttctttccttttactcttttgggtgattatttcattgttttatttcagattttttgctatgagcacagctcgttaatttggagccttattttctatgagaagtgttgaaggccacacagttttctctaaattagtattaactgtacactgcaagttttgctatgtaataatttcatcaacttttggttctaaatatttctaattgccattgtaatttcttcctccacaaatgccttatggttgaaggatttaatttttaatggtcatttttgtagatattccatggatgcttgagaacaccatacattctatacttactggatatggagttctataagttgtcattagatcaagcttattagttgtgttgttgaaatctttttttttttttgagatagggtctcactgcgttgcccagtctggagtgcagtggcacgatcatggcttactgtagcctcgacctcctgggatcaagcgatcctctgacctcagcctcctgagtagctaggaagacgggtatgtgccaccatccttggttaatttttaaattttttgtagagacaaagtcttgctatgttgcccaggctggtcttgacctcctgcgttcaagcaatcctcccaccttggcctcccaaagtgctcggattacatgcatgagccaccttgcctggcccaaatcttttatattcttaatttattgattttttactgcttattttatcaatcacagaaatgtgtgttgaactagctcatgaaatagttgacttgtctaattttccttgtaattctgtcaattttagttcatttttgaagctatattattatatttgtagaagtttataattgttatgccttattggaaaattgaatatcttatcattatatagtaatcttttaatctctagttctgttttgtcctaaaatatattttttctgatattactgttgctatacacactttttggaaacttagtatttacctggtacatcattttccagccttttcttttcttttctttctttcttttttttttttttttttttgagatagtctcgctctgctgcccaggctggagtgcagtggcatgatcttggctcactgcaacctctgcccctcctgggttcaagcgattctcctgcctcagcctcccgagtagctgggactataggtgcgcaccaccacggctgcctaatttttgtatttttagtagagacggggttttgccgtgttggccatgctggtctcgaactcctgacctcaggtgatctgcccacctcagcctcccaagatgctgggattacagatgtcagccactgcgcccggccaatttagggttattattgatacatttatttataccatcttattttgtgttttcttgtcttgttttttcaattttttttgtcctttcttgccttcttttgaattagttttttttctcttttctctaacagtttggaagttacatatactcagtttccaatatgctataaaataccatatattatttaatattttaatatttagtatactatgttatgtgtcttcactatgattattctgggtgcacatttctttttatttattatagtcgaaagttttttggcttctcgaacctgtggattaggaccctttgtcatttatagaaagtaatccttcattagactatatgctgctgataaagacatacccgaaactgggtaatttataaaggaaaagaggtttaatggactcacagttccacatggctggggaggcctcacaatcatggtggaaggcaaaggcacgtcttacatggcagcaggcaaaaagcgaatgagaagcaaacgaatgagaagcaagcgaatgagacgcaagcaaagggggtttccccttataaaaccatcagatctcgtgagacctattcactaccacaagaacagtatgagggaaaccacccccataattcaattatctcccaccaggtccctcccacagcatgtgggaattatgggagctataattcaagatgagatttgagtgaagacacagccaaaccatatcacagaccttctcagtctatcttccatgtctctttaagttctatttcatattttccatatctttagctctcttggctatatgtcgggtaagttctgttctatcttccatgtctctaatcatcctttcagctgtatctagatgttaaacctgtctatggagttttaaatttcagttgttatatttttcatttctacaagttgtttgatttttttccacatctgcttgctcttttgtgatattttcaagactctcttttatttattaaatgatatcaaacatacttgttggatatactaggtttgataactccagcatctaaagtctggatctgaatctgctgtcttgtttctgctggatctcactcatagtgccctgtttatttgtatagttagtgaattattttatttagtgaattatctcattttctttggaatattactgtgggaattctttgaggtcagggatgaggcaaatttcttagttcctcttgaagggatttacacttgcttctctcaggtaactgtgggcattacaagcctaggaccatttctaatcaaatttttggctccaggttttgtgtgtgtgtgtgtgtgtgtgtgtgtgtgtatgtgtttatcttttaggaagggggatagtgcctggtcatgtaaattcatgagggcaggctcatgattacaaattctgaagggagatagcccacccccagctcaatttgattagcatcaggatccaacaagggcagttttcctttcagtcctgtagggatggaataatttttttcttcctttttttttttttctttccgagacagagtcttgctctgtcacctaggctggagtgcagtggcatgatctcggctcactgcagcctctgcctcccaggttcaagcaattctcctgcctcagcctcttgagtagctgggattacaggcgcatgccaccacacccagctaattttgtatttttagtagagacggggtttcatcatgttggccaggctggtctcgaactcctgacctcgtgatccgccggcctcagcctcccaaagtgctgggattacaggcgtgagccactgtgcccggccaaatttatttcttaggccacctttatattagaacgtggccctccagagtcacagttttgcggggagtctcctgttaggcttccctccgggtgggcagtaagctttatcttctgtcctgctagtcccgagaagctaccaagtcctgaaaacctaatttgcataacccaactttgagggtatctacaaaaaatagctttttgtttcctagtctttacagtacaataagacaccctagaaggagatagaaatagtggaaggggtccctgctgtcaaatggcatgcaatatagaggcctgaagtggccagtggtttggataatgaggaagccaaggaggctctcaaattcacagttttgtatgtatcctcaactccaaacctggctcctggctttgcatacctctctaagtccctgtcttcatgcccaagtattacttacattttcttcggcttacatactattttatccagcattttagttattttcagcactttattccttttataattcaaggacaactttccacttgtgtcctgtttaacaacctttattttttttttctattcataaacataatacaaaattgttgtagaaaaagtaaaaagtgcaataagccaaaaagggaaaatggaaattacatgcagttcctgtcactcaaaaaaacactgttaggccgggcatggtggctcacgcctgtaaccccagaactttgggaggctgaggccggcggatcacctgaggtcaggagttcaagaccagcctggccaacatggtgaaaccccgtctctcctaaaaatacaaaaattagcagggcgtggtggcgggcgcctgtcatcccagctactggggaagctgaggcaggagaatcgcttgaacctgggaggcggagtttgcagttggccaagatcgcgccactgcactccagcctgggggacaagagcgagacttcgtcaaaaacaaaaaacaacaaaaaacaaacaaacaaaaaacactgttaacattttgatatatgattttcttggaaaatataggattatatttgtttattcttatatatctacactttggcataatgttggcatgagaaatagtcatgttgagagttaagacagggattgagaaaagctaaattagtttaagccgtgtcaaattattctcaaggaagtcatatatttaagggacagccttggtcagcggatccttctggtcatgatttgggggaggggggcaggaaacatgaggggattgtgttgctatcacaggatgtgtctcaaaactactatgcgggaacttgtatatctccacaactgctgaaggcatctgctgagggtgagtgggaacggaggatgctatacctaggtctctgagctgggctccagaagaacggatggcaggctgttcctcagcgtatgggaaggtgggcaagttggcatcatgacttccgctatggagcaagccagtctcatgggcatgtggccttcgatagcatggctctgctgtcctctatctcaccctcgcccactcttattttgccctccagttactacacacccctgcccaagcctgtgccattgcctggggctgctccatctcagtagtgtagctttgcaacattgaaattgagttttgtctctataagggatgtctgaccattcagtgagtattttcaatgtatctattatatatttgtaaatggaaggggatcatacaatgtttgctttaaaatttgttttgtcacataggaaagtatgaccatctttccatatatcatgagcatcccctcccaccagctgcaagttctccttccatcatgcatctactccttccctctgttctctttggttgacaccttcctttccattaataaacacgttcatctctctaccattcttagaaaaacaaccaaccaaaactcccttgaaactgtatgtcccctccttctactactacctttctctcctcctcctcccttcacagggatcctcaaaccatctgcattcactgaattcactcctcgctttttaatttcaattttttttagagagggggctctcgcctccttggcttccgcgttgtcaaaaccattggccacttcaggccccccacactgcctgccatttgacagcagggatccttccactattcctagctccttctagggtgtcttactgtactgtgaggggtaggaaacaaaaagctacattttgtggacactcttgaagttgggttatgcaaattaggttttcagaatctagaaagcagatgtgagacaggccatattttttgcagttttctttgttttctcctgggaaacaagatcattgaagacatgggatgttcgtgcatcagctttccactatccagtccccactttgtgggaatggaggacacagttgcagttatggtggccacagtactgtgttacaaaacccagctaagttctacaggtggctttacagtagcctgactgttacaggagtggtcgctcctttatggagttacttctgggtgttcagagagattttcctggaggcccaaatagaggtcatttttcagtgtaccgaatgatttttactacctatttgcctgtatcaaattccttttctgctggcttctatttcttgtactgaaccttcaccatttggtatcagaagtggctgtagccaataggcccttaaggatgacaatattcatttgctaaaagaaaataacggctgggagcggtggctcacacttttaatcccagcattttgggaggccgaggcgggtggatcacctgaggtcaagagtttgagaccagcctggccaacatggtgaaaccctgtctctactaaaatgacaaaaattagctgggcgtggtggtgtgcacctgtaatcccagctactcaggaggctgaggcagaattgcttgaacctgggagacagaggttgcagtgagccgagattgcatgactgcactccatcctgggcgatagagcaagaacctgtctcaaaaaaaaagaaaaaagatgaaagaaagaaagaagaaaggaaggaaggaaagaaagaaaagaaagaaagagaaagaaagaaagaaagaaagaaagaaaagaaaacaactacctgcctatcctttatgcccagaaagaaaaaaatctttcaagaacaaggacaaaataaagatattttcaagaaaaccaaaactgaaagttcttcacaagcagatattcagaaaattataaagaatatatatcaggcagaaggaaaaatggttccagatagaagttctgagacggaagtaggaataaagagcaaaataagttggtcattaaatgagagacatgtggaaggtggaagtcaaataaataccatcttcctgctgctttgactgtttccttctagcgagtaaggtataggagatggatacagtttctgaagtagtattccatgctcattcaccggcttcgttgggtgctgctgacaggcggctgtggtggttgggcaatggctttctaaccctgagtcataattaaagtgctgtgttcttgaatgcaatagttccagtgctggtctcctgagtcctcactttcctgatacgggacagaagtagtagctccattggtcagttttgcagtgttctaggagtcattcctggggattcagcctagagcttgatcacccaacccttccaaaggttttgtaagcagctaattccctatattaactcctttttgcataaaacatttagttgtttgcaaacaacaacagcaaaaacaatgcaagctgcttcaacaattcatcatgttgccaggtgtggtggtgcacccctgtagtcccagctccttgggaggcagaggcaggaggattgcttgaccccaggagttcaaggtcagcctggcaacacagcgagacccccatctcttaaaagaaaaagcaggaaacaattgatcatgtcacataaaaaaacaaccagacttggtactgccagggtcccttgccgcttctcaggtcagccttgatgctgcctttctctttgtgtggacataatcctcagttccagccatctcgtccagacatgacaaactgagaagtgtctgtatttttgaggctatctctttttaaaacaggtttattgaaatataattaatataccgtataattttaaagtgtacaattcaatggtttttggtatattcgtagacaggtgcaaccatcaccacagtcagttttacaaattttcatcactcaagaagaaccccatatcatttagttatcacctcccatccttgtccaccaccccagactctggaaaccactaatcttctttctgtctctatagaattccctatcctgaacttccatatgaatgaaatcgtaaggtctgtatggggaaaagaaagagagatcagactgttactgtgtctatgtagaaaaaggaagacataagaaactccattttgatctgtactaagaaaaattcttctgctttgaaatgctattaatctgtaaccctagccccaaccctgtgctcacagaaacatgcgctgtattgactcaaggttaatggatttagggctgtgcaggatgtgctttgttaacaatgtgtttgaaggcagtatgcttggtaaaggtcatcgccattctccagtcttgagtacccagggacacaatgcactgtggaaagccatggggacctctgcccaagaaagcctgggtgttgtccaggcttccccacactgagacagcctgagatgtggcctcgttggaagggaaagaccttacattatagtcccccagccggacacccataaaaggtctgtgctgaggaggattactgaaagaggaaggcctctttgcagttaagaggaaagcatctgtctcatgatcccctgggaatggaatgtcttggtgtaaaacctgatcgtacattctatttactgagataggagaaaaccgccctatggctggaggtgagacatgctggtggcaatactgatctttactgcacggcaatactgatctttactgcactgagatgtttatgtaaagttaaacataaatctagcctacgtgcacattcaggcatagcacctttccttaaacttatttatgacacagagtcttttgttcacatgttttcctgttgaccctctctccaccattaccctatagtcctgccacatccccctcactgagatagtagagataatgatcaataaatactgagggaattcagaaaccagtgccggtgcaggtcctcacttgctgagtgccggtcccctgggcccacttttcttcctctatgctttacctctgtgtcttatttcttttctcagtctctcgtctccaccttgcgagaaatacccacaggtgtggaggggcaggcccccttcagtctctggaggcctttgtggctggcttctttcacttagcagaatgttttcgtggttcgtccgtgttgtagcaggtatcactacgtccttactttttatggccaagtgatatcccattgtgtggatataccatattttgtgtgcccattcatccattgatgaacctctgagttgtttccatgttttggctattgtaaacagtgctactataaacttttgtgtacaagtttattcgtggacatatgtcttcatttctcttggtatatacgtaaagtccctgcatcctatggtaactttatgtttaatcatttggggaaacttccaggttgttttccaaagtggctgtatcattttacattcccaccagaaatgtatgacggttctaaccaacacttgttatctgacttttgggttccatccatctcagtgggtgtgaagtggtatctcattgtggttttgatttgcacctgcatttctctttaagatcaaggaaatcttttccagaagttcaccagcagactttctatcaagtgctgttgaacagaactgcatcaaatacaccttcccaaaccagtcactggcaagggaaatgagattactgatgaagactcacctcctgggttggagctggcactgtgggagcttaccctaacaacaggttctgttaggaaggaggaaggaggcagaggatcagctagctgtgtggctgctacacgtggcttccacgggctctcacagctttcctcctcctcaggccatttgttcttaggcttctcttcctctgtccaccccttaaatgtcaatgttcctggtcttcaatgtcctccatatacactcttttggatcatctcatttattctcatggtttccatttctacttgatgccttctgaaattgcttcttttctgagcttcggatttactgataataataaggaatagtataacaataataatagcactacctttttttatttgtttgcttttatttttatttttatttatttatttatttattttgagacggagtctcactctgtcgcccaggctggagtgcagtggtgcaatctcagctcactgcaagctccacctcccgggttcacgccattctcctacctcagcctcccaagtagctgggactacaggcgactgccaccaggccggctaattttttgcatttttagtagagacgaggtttcaccatgttagccaggatggtctcgatctcctgacctcgtgatccgcccacctcggcctcccaaagtgctgggattacaggcatgagccaccgtgcccggcctagcactaccatttttttttaatttttttgagatggagtcttgcttgtcgcctaggctaggtgcagtggcacgatcttggctcactgcaacctttgtctcccaggttcaagcgattcttctgcctcagcctcctaagtagctgggactacaggcacgcatcaccacgcctggctaatttttgtatttttagtagagatggggtttcaccatcttggccaggctggtctcaaactcctacctcatgacccacctgcctcggcctcccaaagtgctgggattacaggcgtgtgccaccgtgcccagtctagcactgccatttattagatacatattaccttccaggctttgtaccttatcttatttaattatgggaagtctataaccctatccttttttttgttttttaagacagggtctcactctgtcacccaggctggagcgcagtggcatgatctcagctcattgcaacctctgcctcccaggctctagcaatcctcccacctcagcctctatgaacctattcttatccctgtcttacacacaaatgaacaggctttttgcaaaaggtaacggaactactaagttggtggagctggaagatggacccggtctgtttgactccactgccctgctccactgcccgttaggcttctgtacctgcttcaaacacagggcagcccaaaagaactcatcaccttccctggaatgagccctgtccccatgctccctacagcaatgaggaaactaccatgtattagtgtcccacactcctggtaccaatttactgtgttaatctattctcacactgctataaagaactgcccaagactgggcaatttctaaataaaagaggtttcattgactcacagttctacattgctggggaagtttcaggaaacttacagtcatagcggaaggggaagcaggcacctcttcacaaggtggcaagagagagtgtgagtggaggaaatgacggacgcttatggaaccatcagatctcatgagaactccctaactatccgaagaacagcgtgggggaaaccaccccatgatccgatcctctcccaccgggtctttccctcaacacttggggattacaattcaagatgagattggggcggggacacaaaagcctaaccatgtcataccatttgcccaatttagtccagaatcccacgggctatctccctcctcctttgtccctgcactacgtaatgccaacgttgcttgctaattattccttgaacccagctcttgttcctcattctccactgtcattgtctgagtccaggtatgctgtgactggtgtgcatgtacctgggatttcttagccttaggggtggctggctgtgcagaatctttggatggctggaggccctgggttggttgtttctgtttgcaaacagccccctcctttgttaaccagtgtgtcatataacagcaatcattttctgtggatgaataatgagggagatggtaagaagcatgacctggagtagactgcaccgccatccgcctctccactttccctctctcactgcatccttccttctgactgcggcagagacaggccgaatcactcccctgtgagaaacctctggatggggggccatcccctcaccaccctgaggaccaggtccacattccttactgtggctgacaaggccctccatagcttccagtgtccccttcccgcctccactcctgtgttcgtgagtagaattcggtgctccagaaacatcacgcctttctgcagccctctcctctattccgtgctgtttctcaccccagcttcttggctcacacggtttcacttacccaatacgctaataacatggaggttaagaccagcggtggcatcaggtaacccggttcaagtcgttgctctctgtcacttgttcatggtgaaagcactcaatctctctgaaccccaatttatacctcagctttaaaacaagtacctatctcagggctgttgtgaagatgaaatgaagaaaatatgcagacataagtggttgctttctttatccatcttgcttaactgccctaacccccaagaagtcttccctaaccctccttctgaaggaccctgtgcaaaactctgcaggcgccatgcgctgactgttgtctgattatttctctgccctgcttggctgaggtctcccaggcatggagtccctttgagattcatctccagcctgggtgggcccactggggcccatctgtcaaggacagagcaggaggtcctccggagaaggtgacaacgtagtggggcatcgaccataacaaatgcgggagctccagggaacgacccccgcccgctggcgtctctccagtctgagaccccactggaggagctgtccatgtggctgcctctcgccttttatcccaggggacagagccaacgccaagcatggcaaccacccaccttaacctaatcaggatgcagcctgctcattaattcattcattcattcagagggatctgtccgggtgcgggtccagcacgggtccaaatcctgcatctccagtagcctcctgggggtcggtcgtcgggagggctcgtgagcggaaggctttaggatgaagcgacagggcccagagtcgtggagattggactggggggcaggggagcaggcattgacaaccacgccgacaggggcatcccgcgcgcctgtgtgggagaatgtgtagggcaagcagcagggagagaccatctcagagacaggggaacagccaagcagaaaccactgtgctgggcgcggggggaggccgggaaagacagcacatctgcggggcgggaggaggggagggaagggagtagaaacactgctcccgccagccgcgggtgatggggacacgtgtccagctcgctgagtccgagggcctgggcccgctttgggtgccctgtttctccggcgcccaggtgtgtgcgcagaaccgtgtctgctccagggacagccgtgaacgagcgccgtccggagtggcagggccatcaggtgtggctcattccaagaaaggtccgtaccttcacatgtaaacttcctggcaaagctgctgggttgccgcttatgggagaaggcggcgggcccaaggttcggcccctttgtctgaatctggcatttggagcaggctttaagacttcgggaaaagccgggcccctgtgcaaccaccaaaggctgcttctcccgccctcaggactaagatcttgttccagtcctccagtcctcggggtctactccaggggtacaaggtgagagtggctctccagagtccatttgccttttggtgccgcactgcatcctcactttgaccctgagcgctgcagtaagccctgcagggtgctccaccttgaagcacgggaagatctgatgctggccgccttcttccttcggttgcctgaaagggcccgtgtttatccttcgcttcacagagaacgcaacacacaacattaaacacacatagagagtgaaagagaacaaggcatcttcatcaaggagggcgcaccatttaaccacccgcgaccttgcagtgcgcctctgcaaagtggggactccgctctgtagcaggagatgggggtgttgacgattttgaaagtagttctcagttttccgaggcaaaggtgtctggggctgacgaatgacttttgagaagaaggaatgatgagaaatgtcctcattacagaactttcccggccacactgtgagtcccacgcaaagaccccatgaccaccaaccggagcgctgggtgctccctggcagggtcacctttgctttttgcgcgcccccatgccacccctggggcaggaggccatcctcttatcctgggagtgcaggcctggcccgaagtgcagcccccgaggccgggagccgagattcttctcggcttcgtgctcagagctttgcagcgtggcatggtttcctcctcttgccctgttgctgtttcataccagggggaactgagacccagtcgggttatgggcctccctgagaacactggcctctagcagaagcagattcaaccccaggcctcaacctgcgcccagacccgtgccctggagtggagtttacccactgccgcccttcctgggcaaatgtcaccgctgcctccgtccccctaggtccggggcgggtcagtgcttcgagccagcggaccccggcctagggacaggtgcctgcgagaatgcggggggcggcccccagctcccctgccctcctccctagaggctgggcctgctggtctcccggctgcgcgcaaggtgggaacgcggccgacttggtccgctcgccctccccgcacccgctcctctggagccgctggggctgcgcaccgactcacccgcgcggcctccgggctgcgccttcagcgctggcggcgtcctgcccggcgagggccagggtcccaggaggccccggaggcggcgggaccgcagggcggaggggaggccgtgggagcggccgggcgcgcctcagcagcgcggagact

SEQ ID NO: 2209 - DNA, 70438 bp, Homo sapiens
attaaggtagttcatctaaaacttcagtgtcactgcccactgctgtcgtggctgcttgctcagatgaggttttttggggccaactgattcctaacaaatttgagagcttctgtagcagtgtatctattagtgcagcttctttctgagtattgaagacaaaaagagaaaagtgagaaaattgaaattactgctaatagtggagtaaaaaaagtaccaaagatttttaaaaaattagtaaatgtaaagatactatttctttaataatttgcagtcaggcattggagtgtttccactaatggttgcgagccaactatttataggacaatggctatagaatattatgtagtcttataaattgggtttcctaggaagatagctggcagagcttttgaaactaataaagggaatatgatactgtgcattataaattatgtcagcccgtcatcttaggggcagttacagtggagctttcccagtgatataacagcatgctagtttatcttttagttacctaccttaagcgactttctttcttttccaaaggccatgagaatggccgaaacgaaaagattaattaccacaagtaccatcaagatgacactggtgaggatcagaaaggtgcccaggactgggtctaaagcgaaaacctgggaaaacaataagaacacttgcagtgactgacaatttagtttatactttacaaacataagctatatgctagtgtttgggatcttatcagaagaaaagcttatccgaaggaaacttagggagagagtcaaaagataataagaaggaaaatacttttaaatggacagaagagcaggaatgactcattttaaggaggttaagataattgtgactgcagggctttcacaagaaaacaggtgagttgcagtggaattggaaatgattcaaatgtcacatgagttttggcaaaaaatacatctaatcatggaagctaaaagtgggaggggggtaagcaaacactgaaagattaaatgcataccagaaatgagaatgcacactgtctctgccatatcaagaaactacaaccctaaacacaggagcattccaataaaagttaacaggttggccacagaaaactggctttttagtatttttttttttccattgtcatttttaaaggtacaagcattgagttctgccattctttacttttctgcatacataaatatcaagttctgggcttattggaatggttcccataacaaaaactgttgtttaaaatttagatgttctttttcaacaaatggtatttattttcccttggtattggcccattcattgttgccactagggcactgtttaaaaatatcccaacagaggggttgattacagtcaatgccaccctgatggaaatctatatggcaaaatattttcaagcaccaaactgttttacctacttaaaaatgattattataacaatttcaggtcaaccagataatgtgggcaatctctgagtttgtgatacaagacttatttccaataagtttatttttatgtacaattttactgtttattttttgtttgctctatttgttttttaatgttttttactttatgtttactgtatttttatgtacaattacatccaaagcagaaaagttccttttttatccccaaaaggaggtgtcagcaaaaatttgttactctgattacttccttcacagctttaggatacgaagtgctgcagtggcaaaggctcatcccctagttattggagctagaaccacaacagaacacagcctagtcagccaaaacagcagttacagttgtcccttagtatctgagagagattggcgccagggcccccacaggtaccaaaatctgaggatgcttaagtcccttatttttattttttaattgcaagcttccctaaaggttaagaaagtgtcttctcccccactttttttttttttttttttttttgaaatggtcttgctctcaccccggctggagtgcagtggcgtgatcttggctcactgcaacctccacctcccaggttcaagcgattctcctcagtcagtctcctgagtggctgggattacaggttcccaccaccatgcctggctaatttttgtattttagtagagacgggattttaccatgttggccaggctggtcttgaactcctgacctcaagtgatcagccccaccttggccttctagagtgctgggattacaggcgtgagctactgtgcccggctcaaagtccctttttaaaaatggcacagtatttgcataaaccctatatacatctctcttatacttgaaataaactttagattacctctagtactttatagtggaactgctacgtaaaatagttgttacaccggtttgtggttttttgtgggagacagtctcgctcagagggcagtgggatgatcatagctcattgcatcctcactcctgagctcaagcaatcttttcactttggcctcctaagtaacaggaactacaggtacatgctaccatgcctgactcttctactgtattttaaaatgtgtgttatattttattgttacctttcaaatattttcattctgggattggttgaatctgtggatgcagaccctgcagatacaacattagaaactgaacctacccattttaattagtaattttggaattctagatcattagaatgatcaaccatgatcaaaatcttgccagtttcactgcttaaatggcaggtttttccttgcttggtcatatctaccctttacataccagggtttggagcccagtgcctcatttgggtttcctactttatatgttgaggaggaaggcagggatttctgttggtagttcctgggaggaaataataggctctctgaagtgagtagttattaactcaacagaaataacgcagtttctcttagaactgtaccttcctaattctttgtcacttccattatgtcacttttttttttgagacagtttcactgtcttgcccaggctggagtgcagtggcacaatctcagctcactgcaacctccgcctgccaggttaaggcaattctcctgcatcaacctcctgaggagctgggattacaggtgtgcaccaccacgcctggctaggctaatttttgtgtttttattagagatggggtttcaccatgttggccaggctggtcttgaactcctgacctcaaaagtgatccgctggcttcggcttcccaaagtattaggattataggcatgagccaccgcacctggcctttttttttttttttttttttttttaatttaaatagacatagggtctggagtgtagtggcatgatcatggcttattgcagcttccaactcctgggctcacaggattctctctcctcagcctccagcctcctgagtggctaggactacaggtgcatgccaccacacctggctaatttttattttttatttttagtagagacaaagtctctatgttgcccaggctggtctcaaattcttggcctcaagcagtcctccccttcttggcctctcatggcttgaaccaacttaccctaccctgttaatgcactttcaaggggccattgagaagcagagaatcttgttaatctggccaagcacaagagcacaagcttcggctcagtgtcctttgccaataagattaaggacacaagaagtgaggaaggagggactgagtgcttaggaaagggcaggtttctgaaagcaacagccatgtaaatgctgtatgcataggcagtaccataaagcagtagagcaaaggactgaaattttcccccttttccagtgtgcagtgtacagtagggggctgttttcataaggacccccccaattttccttgttcaatatattgaattctgtgaggaaacaaattattatttttacctcctcttggtgagaaattcccatcaggagaccaacaacagtcactgctgagctgaaaaatgtccggtagtcagagatgctgcatccaaacagcaggttaaactgaacagaaggagaaaggccagttagtgcaagccgagcgcacatctttctatcctgaggtgcttggggatgtggccaacatagaagcaatggaacagaaattccttgtggccaaattatgcccaaagaatacataaacttcctttgtaataacatagtgttttcatagaagtttatttgacctttatattaccgtgtgagctaagttttatccccattttagagaaaaatatgtgggtttaagtcataccagttaagtgtggaactagatctaaacccggctttcctactgtaccacctcgggtttctgtgttgtgaccatttctatgggaagcgatgcgattccaagaccacagcacacggagaaggagagacagcaacgtgggggcttacggcaatggcatagcctgtcagcaggattaggatgatcagcagaaagcccaccacctcgtcccaggctcggctcagtgtcctgctgatgacccgcagcctggggctatgacgcagcaggttccataactgaacagttgccaggagaaccgggaagcccacaaggtgagtcgcagcagagttcacttttactgcctcatagaagctgatgaatctgcaccaaggaaagctgacagttactcagcaagaagtatgtgcctatactgcagtttccccagcgcccctgctgctgatcgtggcagccctgagtcctgtgaggtcaaatgcttgttgatgtgagaactgctttctattgtggcctcctgtgagttgtggatatgggagtaacagaaggccacatactattcaagtgatctacctgctgcagattgcactgggagctgtgccgaagaagccttaaaatgtgacctctagctgatttctttattccaaattcatcctgggaagcaaaaccagcctcctgcactgctctgagccaaatctctcctctcaaaaggagattaactcagcccagagagaggagccatgctgctggtctgttttctgtggcacactaatcctgtgttctctggcagtacaggattgctgtaataggtgcaatcaagcttagaacaaaatgatgggtggtagactagaggcgaggggtgttgcttagcaattaggttttgttttgagagagagacattcataattttaggttgcagcaaccaggttacttggaaggagccccacagacactagcaagtggcactctgcacagatccgctgtcactgcataaactgctctccataaggcctacttgaaacaatgcctcaggaaaagttacacagatcaccacccaggctgttggccactgatgcaaaggttagcaaagcaccacttggcaacacttggcatgggaaacatagatgttcctctccatgggaaaaaccagagaaggtgcccaaagaggcaccaaaaatctcttagtatggatgagtgaatagatgaacatccctacccagaaagcagctccctttgcatttaaaggatgggactatgtgttgtggttttatttaaaggattatttgtcgtgcgttaggctttatgccttcgccagagggcaaaataatgaccaattccaggcccttctgaaatttaaatgcattatccttaagcacatacctaagcactaatgaaggcagaagagctcttcaatgtgactagcagttaaatggcttctagttcactgtcttctctgctgtggacatgagtccaagttctcttttaactctaatgttatgcaaatacagatctggtaggggagtttgaagaatacttgtgtataaacaggaaactttagacatgaggtaggaatatgctgtgcccctcaggcttcctctcacctgtcctggtcatcgcggtatcgtgccatgtttttcttatgtagagaaatactcttcatgtcaagccccaggaggatgaagctaatgaggattatacttgtgtccagaatgtttcttttcccagtgaagaacctccacttctgctgtttcagctgacaaccctaaacatagacagcacagtcactgttgcttgtctgagagattagctaggtctctccctgctcaagtgtgatgaacgcagctgatgtctgtgggcaaagcacactgccaggcatttatcagatctcacttggacaaatgggttatggtcttagttcaggtctgtagtcttcagaaatgctgcttacaaaaaagttatcttcaaacaacttccattggatacatttattctttttcttggagatcataaactgtcacttaaaaatcaataatacaaaagtttctttctttgagacagggtcgcgctctgttgcccaggctggagtgcagtggtgcgatcatagctcactgcagcctcaacctcccaggctcaggctcaagcagtcctcctacctcagcctcccaagtagcagggaccacgagcacatgccaccatgcccggctaagttttgtattttttgtagagacagggttttgacattttgcccaggctagtcttgaactcctggcttcaagtgatctgcctacctcagcctcccaaggtgctgggattacaggcgtgagccaccatgcccagcaaaaatttctaaattagttatcaagcctgagaatgaaaaaaaaaatactatgtttggcttaagatataaatatattttcttctgagtgtaatcatctgtatttttttttcttttctttttttttttttgagacagagtttcactcttgtcacccaggctggagtgtagtggtgccatcttggctcactgcaacctctgcctcccaggttcaagcaattctgccccagtctcccgagtagctgggactataggagcccgccaccatgcccagctgatttttgtatttttagtagagacagggtttcgccatgttggccaggctggtcttgaactcctgacctcaggtgatcaacccatcttggcctcccaaaatgttgggattacaggcgtgagccactgtgcctggccaatcacttttttttttctttttttttttttttttgagatgcagtttcactcttgttgcccaagctgaagtgcaagggcgcgatctcggctcactgcaacctccgcctcccgagcagctgggattacaggcatatgccaccacgcccggctaaatttgtatttttagtagagacggcatttctctatgttggccaggctggtctcgaactccctcaggtaatccgcctgcctcggcctcctaaagtgcttgaactacaggcatgagccaatcatttgtatttttgagtgcttgctctttgttcatcatacttgcttggtattacttcatatagggctaataaaactacaaaagtactatttctatagacttaattctttagctcctgaaaaattgaaagagccaatctatttggtggaaaaccagtcagcctttaactgaattcaggtttctgaaaaggaccaaaattatagccataattctagtaacatgtcattgtagagcttcccaaataaaatgtggcaacctttatttctcacatctaacaccatcatcatcatcatcattatttttgagacagggtcttgctctgtcgcccaggctgaagtgcagtggcgtgatcttagctcactgcaacctctgcctcccaggctcaagcaattctcacatctcagcctcccgagtagctgggaccacaggtgcatgccaccacacctgggtaatttttgtagtctggtaaagatgaggttttgccatgttgcccaggctgacatctaacattattgactcacctgtatgaaggcatagtaacagaccagtagataatagatgacttgtgagatgatagaccagacacagcccttctttgacatctgaagggaagtgaagctttccagtctcaaagaggtgaagaaagcacctgagaataacaaagaacacctggagtcaagagtctaaaacttttgccctcttcttgttaaactttgtctttgaataaccccaactcttcctgtatcatcaaatgtttctgagtctcagtgctccacttagtatttcctttagagctgtcatgaacattaaaggagatcatgtatgcaaagctattggagaaatactggttttacaaaagtcagtagtgggaaaggatatgctgttgaccctaccttgaagggaggtgtcggtggcttaacagttattatagatgttaccctatccatgtcagagtggctgcagagagaggtctaaagcactgataccccacgagtactaacggtatcccatggatactcagtcatttacataaggatggactaaaaggcttcagcctccacctggaaggacattgaaaatgttgacgtttataaaatcatgaaaggtcttgtgaatacaaacctttcacaaagcttcaaaatattagtgatggcagcagcaccctgtctggagtggctgctgccatgacatcggctgcagtgggaggcatggccggggctttgtgcgctgttgagctgcgggagccagtaacaggtgggagccctgcccccttctgagttggagggttgggagccccacactcctgggcagagctgcagctgcccagccacagctgcagacctgggcatccctgcactcgggggctcaggaaacccccctgcccctgcaggttcagaagtgcctgctcccactgcatggcctctccccactcccagcacctgctctgattttggagcaaagttttggccaagcctgggtgtgtgtgcgcttggggcagtgctgacaagcagccccctactgcctcggccttctccgaactttggacacggacaagcatgtgaggcagggagggtaagggggggctgagggtggcttgccatgggcccgcaggtgccccttggcacaaacagcctgggcaccatgggtgacatggatggcagcaggaggcagacaggctcctgggcagaaaggggcaggtccccagtaaagccccacctttaaagccagggatcatttgaagcctgggggctgggctgccagttctggaacctgccagtttcactaactcaattgagaacttatggcgcttcttctgggcccacccatggctgcccatggaccaataagcacacacttactcccctctgaagcccataaaaacaccagactcagccagacttgggcagatggcaggatgacctgcctgcagataggagctacccactccagatctctctgctgagggctacacaaacaatgggacgacctgcctgtggataggagctaccaactccaggtttcctgaaaactgtcttgtcactcaatgaagctcctctccacctctctcaccctccagttgtcagtgtacctcattcttcctggatgcaggacaagaactcgggacccgctgagtggtgggactgaaagagctgtaacacaaacagggctgaaacacacccccttgcttgccacactgcaagcaatgagaaggacagaatagctgtggccctttgggggagcccagacctacaggctccctgagccagggctgtgacaccctctttggggctctgtgcttctggcatctcgaagattctaggcaccatggcattcctcagatgcagttacccacagcagaaaccacatgcagtacatctggtccagcttcagtctttcagggagccggcacctgtgccagcacatagagctgcccaactcactgcagcagccagcgtgcctggctgtgtgcaatggctggaccccgtgcttgctcatccatacatacctcactgctctgtacctggctgtctcttggcaggtgtgggatccaggccagtagcaggagctgagtacaggctaccaggccaattcggcagaacgagcacagtggctgcaagcaatactcaggcagaaggtgctgccggccacagaggtttctggctggcaaagcaacaccctaaggatgctgtgacattagaactaagatgtaccccttgtaggtaaaaaagacatttaagaacaaaaggaatttctatttcacctagctagctctcaagactggaacttttcccatgtttattttaatccctgtctatattttgttagtaactaaaaaccccatgaagacccttaggaagcctttgtgcttcattagaaacaagcataagagaagtggtctactctctgcaggtctgagagaagaattcttgattaggagaaagatgtgatggaaaatggaaggatacttgtgagccaattctgggagaagaaagagaagttggattaggatagatgtcctgtgaaaggtgggggaactgaatggaccagtttaactccaatcccttacaaaatgccactataatgaaagtgacaggataaagtaaaaacttcaatagatgaagaaaaggagggcagatgagagcaacaaactgctggaagctgaaaagtagaggaatcacattgacttagcaagttcaagaaagctgaaatctaaggcagctgtacaggaaacccggaagcaagctaattctaaccaagaaaccttggaaagcctcagaaattgcaggcatcaggtacttctgaaggtagaagttcaggtggaactgaaaatagcatcaactgaaagtcaatatatatataaacaacaactagattccaaatttcctccctcaccattcacaaccaggtatttgctacctatcttgccttctaccaccccatgactaaaggtttgtttcccagtgatgctgtatgagagaatctggacttgggggcaccagctacctctgagagtaatggtttactggaaaaggggattaagggaaagtttacgtgctgcatggtgagacacttcccagatcccttccctcaacttgctctgataagtataataggctcatatactcaagattggagtttgtagggtctctaaaaactgactgcccaaaaagagagacttagatacccagttgataagctctatgcatgggcacagagctttgttttttattttttttttatttttttgagatggagtctcactctgtcccccaggctggagtgcagtggcacgatctcagctcactgcaacctccgcctcctgggttcaagcaattctcctgtctcagcctcctgagtagctgggattacaggcatgtgccaccatgcctggctaatttttgtatttttagtagatatggggttttgccaagttagccaggctagtctcaaactcctgacttcaggtcatctgcctgcctcggcctcccaaagtgctgggattacaggtgtgagctaccatgcccagccaggcacagagcttataattagcatttatttgctttttattgccttttttttttcttgatacagggtctggctctcacccaggctggagtgcactggtatgatctcagctcactacaacctttgattcccaggatcaaaccattctgccacctcagcctcccaagtagctgagacaacatgtgcacaccaccatgccaggctaatttttgtatttttggtagagacgaggtttcacaccatgttgcccaggctggtctcgaactcctgggctcaagtgatcttcctgccttggcctcccaaagtgctgggattataggcttgagacaccgcacccagcctgcctttctttaaaaggacagccaggcacttgaacctctaatgctgaaaactgtagatcaaaacaaacaacaaatcaaaaaactagagacagtaaaggatcagaaggaaaaaaaccaccataatatcctcagagttaagaggatattgcatccgtaaaagaacaataagagactatgaaaaaaacaatttggaaattaaatattatagaaagaaaaaatagtttagaagataaaaattaaatactgcagatattagatgaaaaagatggaaaacagaagcaaaaatataagaaaatcagaactccaggagttacaatgtcaaaatgctagaaaatcagaaaaagtgaacagaaaaaatggagaagaaattaaccaaaaaaatgcaagaaaattcctcagaacttaaggtcacgtttccagatgatagaacattctatgacattctttttttttttttttttttttgagatggagtctcgctctgtcacccaggctggagagcagtggcaccgtctcagctcactgcaacctccacctcctgggttcaagcgattcttctgcttcagcctcccgaatagttgggactgcaggcgcgagccaccatgcctgggtaatttttgtatttttagtagagacggggtgtcaccatattggccaggctggtctcgaactcctagaccttgtgatccacctgcctcggcctcccaaagtgctgggattacaggcatgagccaccgtgcccgacctctatgacattctttcataactcagaggacaaagaaaaaaacctaaaaacttttggggttggggactgggaatcagcatgccagcataatactttttaacactaacatgaaaagctagaaagcaatggagctacacttttcaaaattctggctgggcacggtggctcatacctgtaatcccagcactttcggaggccaaggtggtcagttcacttgaggtcaggagttcaagaccagcctggcaaacatggcgaaaccccataaaatatgtaaatacataaattgtaaaaataaaaaaatcagccaggcatggtggcgggcacctgtaatcccagttacttgggaggctcaggcagggagaactgcttgaacccaggaggcagagggtacagagagccaagatggtgccactgcactccagcctgggcgacagagcaagactccgtctcaaacaaacgaaccaaaatcctgcaagaaagaaattatatacagataaattagaatctaatgtgatgggagaataaaaacacttttggagatgtaagtctccaacaaatttacctctcttgtactcttccaggaagttaccttcaatgaaaccacattcctggttttgcacttattgaacagccttctttgctacgtgtggttgaattccaggggtcactccagttacctctcatgatgtaactgaatccattctcattcttgcttgtcagcctttcgtgaagctcatcagtgggaatcagcaccatgggcctgggtgaacagatgtaactgaacctccttagatgaagtccagggaataggctcttgggacgcccacaggtatggccgttatcacaaaacgccagctgaccttcgtccactttctcataggtcttggtacggggtatttggaaaattaattgtaccccacatttgcaatgactgggctccaggactgcattcttacctctgtaatccccatacaggctaggaagaaggatatgattggcccaggggtagaaatcctgaagaagtttgatttccgagaactggtgcgaaaatgtcttccagatagcttggtggaggtaaaatctattggagttctttgcagagtagattgcagtcatcaacagggtaaggaagaggatttgtacttgtttagaagaggaaaaaaatgtcatagttgagtggttaacttagaaatcctctatgtctttttcatttttcctaagtctatagacttatgcaggtcaaaaccagtcaaaaactggctgtttcatatggttcaatctaataattataaatacatacatacacatttccttcccagaattattctgccactaatgatacattttacttaaaataagatacaatggctgtggctgggcacagtggctcacacctgtaatcctagcactttgggaagctgagacgggcagatcacctgaggtcaggagttcgagaccagcctgaccaacatagtaaaacccccccatctactagaaatacaaaaattagctgggcgtggtggtctgtgcctgtaatcccagctaaccaggaggccgaggtaggagaatcgctagaacccaggaggcacaggatgcagtgagctgacattgcaccactgcactccagcctgggcaacaaagtgagactccgtctcaaaaaaaaaaaaaaaaaaaaacataaaatcccgcacaagaaatatggtgtttagctctaaggactaagcatgcactctgtctctcatgtgattgtgtttacaagaagtgaagtcatgataaaagcagaatttgtcttatttggactagggaatccaataatgaactagatgtgttgaagccagtcaactggcacctacagaagagccatctgccaaagcattttcattttccctccatagatcaagtgttattacattttgcaggtggagaaagtgacttactcaagcacacaataaaacctctagactccaaggtcagggatctgtccagttaccatcccacctgctttactggaatcccaaatctcacagggtgaagattttaaaagacagctttttaacccttctttattttccattttattctctctcttcctttcccttctggaaaaggtgctgtgttatcagtatgttgccatttcctctccatacccaaaatatctccagtcagcttgaagagtttcttctttttcaaggttctttctgggtgcttagttggactatttatagctggggctacatagacggggttgttcttatctcttgaacctggtactgacgaagaacattttgctgtcaaaaattcaaatatagaccaaagaaatgttatatttcattaagcagtcactcaccattcattgagcatctactgtgagcacctccttttaaatgttaaacaaggaataaaactacctatgcagtgcttcttaaactctctattataaaggacctgttttttaaaaaattccaatcaattggggactgatacttttgtacaatacagtaaaaatgagttactaggctgaacacagcggctcatgcctgtaattccaattctagcactttgggaggccaaggcagcaggatcacttgaggccaggagttgaccagcctggtcaacatagtgagacgttgtctctacaaaaaaataaaaaattagccaggcatagtggctcatgcctgtggtcccggctactagggagactgaggtgagaggactgattaagcccaggagtttgatgttgtactgagactagcagatagtttgagctcaggagtttgagaccagcctgggcaacatagcaagaccatatctgttttttgtttgttttttttttttgagacggagtctcacttcgttgtcgaggctggagtgcaatgcatgatcttggctcactgcagtctccacctcccagattcaagcgattctcttgcctcaacctcctgagtagctgggattacaggcacatgccaccacacctggctaatttttgtattttcagtagagacagggttttgccatgttgcccaggctgatctcgaactcctacctcaggcgatcaacccgagaccctgtctcttaaaaaaaaattaaaacatatattaaaaaaagaaaaaaataaagcagaagcatgcaaaatacaagccctgtttttgataattagatttagtacatataaagttaatctgccaaattgttaaagtttttaaatgctcattcctgattcctgtacttagactagaaacaaactgttctagtcagtggatcacactttgggagcactgttctatagtggtattctcagattttaatgtgcataggaatcatctgggaattttattaaaatatggattctggagtgaggcctaagattctgaatttcttaactatatatatatatatatatatatatatatatatatatatacacacacacacacacatatatacacacacacacacatatatttatatatgtatttatatacacacacgcacacacacatatatatatatatatttatttatttatttatttatttatttatatatgtattgggaggccaaggaggactgatcacctgagctgaggagttcaagaccagcctggccaatatgggaaaaacttgtctctactaaaaataaaaagttatccaggcgtggtggagtgcacctgtaatcacagctactcgggaggctgacacaggagaactgcttgaatctgggaggcagaggttgcagtgagccgagattgtgccactgcactccaacctgggcgacagagcaagactccatctcataaataaataaataaaaataaaaataactagaggagggcatgaaacttgccagcatgtgtgttccaagcaccatgggatcagtgaagagtgagcaaataaatctctccaagaaagtcagagaaggcgccacagaggaagtgacatttgacatttgttttgaaggatgaatcagagctctccagatgaacaagggtgatgataaggggaaaaaagtctcttttaggcagagaaaccaacagttcagaatgcacagagaaacaaaataagtgcaaggaaggcaatttattattatttttgagacgaagttccgctcttgtcacccaggctggagtacgatggcacgatcttggctcactgcaacctccgcctcccaggttcaagcgattctcctgcctcagcctcccacgtagctgggattacaggcatgcaccaccacacccagctaattttgtatttttagtagagacagggtttcaccatgttggccaggctggtcacaaatggaaggcagtttaaagtcagattaagttttttcatctcacaaggaatggagtgcctactgcttagcagtagatcaccacttaagaataagtgactgccaacataaagtgtgctgtgtacccctctgtgatggcattccttctttccctcacaggtagtcctttcctgaattctggagtttatcattcccatgcatttctttatactttatctataaatgcatagaggagatacatatataacctcttgtcaagacatgcatcgtttttacatgattaagatattgtgccaatttttctgcaacctcttgttttgcccaagattgtgtttgtgaggttcatccaggtgataagttagccctagtcagttagagggtaggccagttagccttagccagttagagggtaggcactctccagcatggtgactaaatgtggaaactaacagaggaatttaggattatgtactccgactttttcagagaatgctgatgctcttgactgaaatgagaaaatatagtaaagaagtggatttgtggggcaggcaaacaattcagtttaatttgacatacttggaggcatctagctccagatagggagcagtggagaacagcacctggggctcatgagagagggggaggaggagggagaaggggatgagggagagaaggagagagggagagagagagggagagagagagggagagagagagggagagagggagggggagagagagagagagaaagggagagagagagggagagagagatgaaaaagatctaaaatgtaggggagtccgggggcggtggctcacgcctgtaatcccagcacttgggaggccgaggagagtggatcacctgaggtcaggagttcaagaccagcctggccaacatggcaaaaccctgtctctactaatactacaaaaaaattagccaggcatggtggcagaggcctgtaatcccagctactcggaggctgagacaggagaatcgcttgaacccaggaggtggaggttgtagtgagctgagaacacatcattgcactccagccttgacaacaagagtgaaactccgtctcaaaaaaataaaattaaataaaatgcaggggagagatgaagcactgggagagaggatgtgatgactgaggtgaagatcctcatctggaagggcattagtcttgggcagaaaaggagaaataaccagttggttagagacaagtcctttgaatgggttaatttatcgagtcagcaaggtggccagatctaatttgctttttgcaaaattaggtagttgttagaactacttgagttacccaagagtgccaagatcctctttgttgttcattctctttgttaagccgtggcatcctgctcatcatcagtgagtataagaatgtgaagaagaccacctgggcaggagaatcacagaacatcgtgagcagacattacagacccaggaagataataccgtatgtaaaggaagaggtgggcactcatgaaaaacttcaattatttggctcttcattttaatgaaaaactaatttcacattaatttttgcacaatgatgggtaccaggagaaggaccatcagactctaaataatgctaatattcatattttttgcttatagttcttaatctggttggctgggggagcttacactgtcaaacgatttgtgttgtctattcaataacatctctcagtatctttggaaaacctctgataaagatccagactcttttttttttttttgagacggagtctcgctctgtcacccaggctggaatgcagtggcgcaatctcggctcactgcaacctccgcttcctgggttcaagcgattctcttccttcagcctcccgagtagctgggactacaggtgcataccacacccagtttattttattattattttttttgagacagagtcttgttctgttgcccaggctggagtacaacggcacgatcttggctcagtgcaacctctgcctcccgggttcaagtgattctccctgcctcagcctcctgagtagctgggattacaggcactcaccactatacctggctaatttttatatttttagtagagacacggtttcgccatgttggccaggctggtctcaaactcctgacctcaggtaatccgcctgcctcggcctcccaaagtgctgggtttacaggcgtgagcccccacagctggcctgggatttttgtattcttaatagagacagggtttcactgtgttgaccaggttggtcttgaactcccaacctcaagtgatctgcccaccttggcctcccaaagtgctaggattacaggcatgagccactgcgcccagccactatggattttcttgagatggatccttagatgtgaaacctctctagcaaaaggtgcagaagttgcaggttgtcactacatattgccagattttccttaacgagcactggctgttcatttccttggcattactgtgtattattatttttctttgccattattaaaacaaaaatgcaatattatcattttattggactagtgaaactgaatttcttacatgtgttttggccactgcaattacaggttttgctttaaaaaatttatatcttaacttacatatagtaaaaaaaaaaaaaaaaaaaaaagtcactttttggtgtgtaattccatgagtgttgtttaatacttagagttgtatatccaccactacagtcaagataccaagtagtttcatcacccccaaaattccctcaggctgtccctttgtatttatatttattttccatatctaaaagatacagaacagtctgtatcttttagaaatataaagtctgaagtacatgaaatggataaaatgatatgaagtctgatattgttccccccaaataatagatgaaacaaattggccatgagttggttattgttgaagctgggtggtacgactttagaatgcattgtactagtctctacacttttgtgtgggtttgacatttttcttaattaaaaacattttaagttttttgttgtttatttttttcaaagtgctttgggttgttgatttgttactgtcctcttcactcctcaatccttttctgccatacttcttagttttttctgtcatgaattacacttatccctaacaaatgtcagttaaatgtcagtttgcttttttttttttttttttagttttgagacagggtctcactctgtcacctaggctggagtacagtggcgcaatcacggcttactgcagcctcgacctcctgggccaagcaatcctcccaccttagactcctaagtagctggaactataggagcacaccaccatgcctggctaattttttctaatttttgtagacatggagtttcatcatgttgcccaggctggtctcgaacacctggactcaagcaatctgcctgccttggcctcccaaattgctgggattacatgtgtgagccactacacccagcctggtttgcctatttgttttttgttgtttatgttacattgtcaaaaccactaggcaccttggattgacacccagggacctcagttcccctaacttctgcaactccaatggttcttcccatccctcacatacctttactggctggctgatgaagatgttctgaagcactgataaaataattgaaatcatccagctggtggcttggtctttgctcaattccaagctataaagtgctgtaaaaaaggctgaagccaggctagtgaaacctaagaggagccagcagactgaagtcaaccatttggacaggccatttgagatgggcttttttccttcttctgagctcaggatggcaaaactggtgacttccctgaagcacaaaagttgagggaataatcttgtatgcatcggctgagatagaggatgaggaagattacaggggataaagaaggcttggtgtggtgcattacctggatggctcttgctccgtgggaagaatatgtgtttccaagagttcctggagtttttgaagttggctggctgcatctaggaagtcacaggactggtgaccctgggtgagacccagcgtgcctaagtgagatttcagcctctgcagaactctatgcaggtaacagcagaaatgatggtggttttcaggaacaactgaaaatatatttcaagttgacactttcacaagtggatttcaataagaagcaattagtggtagagattaacaattcattgatggatgatgaggctatattttcccactactagcagagattggaccgtaccccacatttgcagtactaccatcttctctaaggatgctggtgaatttttaacaattgtaaaattctaagctttgatctaaagacttttaaaaccttattgagttcttcaccagaatggcagtacatgtgacctatactagtaagtgcccaggagactcaaacagtatttgagaatccataaattccataatctcatcatctcataaaagaaaaaggatgacaagtttcaacagcctttgacaaagcagaaaggatatgtgggtataatacagaaaacttttttttgtatttctctcttttttttttttttgagatggagtcttggtctgtcgtccaggctgagtgtagtggcacgatcttggctcactgaaacctctgcctcccgggttcaagtgatcctcctgcctcagcctctctagtagctaagattacaggcatctgccaccatgaccagctaatttttttttttttttgtatttttagtagagacagggttttgtcacattggccaggctggttttgaacttctgacctcaggtgatctgcatgccttggcctcccaaaatgctgggattacaggcgtgagccaccctgcccgacctgtgtttttttcttttttcaagacagagcctatgttgcccaagctggagtgtagtggcgcgatctcagctcactgcaacctctgcctcctgagttcaagcaattctcctgcctcagcctcccccgtagctgggattacaggcgcccgccactacacctggctaatttttgtatttttagtagagacagggtttcgccatgttggctaggctggccctgatctcctgacctcaggtaatctgcccacctcggcctctcaaagtgccgggattacaggcgtgacccacatctggcttgtgtttttttcttaatcctgtactttgtttcaccagatagagaaagattgtctacaagtcatcaaggagaacaaagctatcaactctatactagaagcttaaggaaattaaaacaaccagaaggttgtatcaggcctgtcggttatgaatgagtaagaaagtaagacatatgcaagggagtgggaggcagatggaagattcgttactgaaatctactgaagtttaccacgtgcccagtggcgctctccctgctgatgacagccttgaccctccaagtgagatgatacgaggctggataaaagtttcaccagcttagtaatgtcccaagaactccatggcggctgctcacacttggagagtaggtatgtatttctcctgagcaggaatctcacagtttcctttaattcctgaatgtaggaccagatgagaaaaatcagcctgtttttcattaacccaggatttgtaccaattacaggtggtaaggccgttccctttcgtcagaaggggatatgcttagcacaaagaacctcaatttttcatgttcctctaatttttcagaaagcagtcacctcacagctcatggtagctgcaataccagttttatgagacaatacagaatgaaaaaagagacaatttgatcaaacatcaaagactaaagcaaggccagagtggtaccatgcactcccatttagttctcagaatacttaatcatcaagagtaaaagctaagcatgtggttgatcacggctcagggcacaggaattgggaaaaatatattacaggtaacaggaccctgacagcctcccatgagattcttcccactgctctcttccactgcgtggggaaagggagcatgtcattttttttttttttttttttttttttttttgagacggagtcttgctctgtctctgttgccaggctggagtgcaggggcgcaatcttggctcactgcaacctccgcctcctgggttcaagtgattctcctggctcagcttcctgagtagctgggactacagatgcatgccatcacgcctggctaattattatttttttgtctttttagtagagacggggtttcaccatgttagccaggatggtctcgatctcctgacctcgtgatccgcctgcctcggcctcccaaagtgctgagattacaggcgtgagccaccgtgcccagctgggagcacgtaatttatctgtaaaatttgatactggctgggcacggtggcttacgcctgaaatcccagcactttgggaggccaaggtgggaggatggcttgagcccaagggtttgagaccagcctgggtaacatggtgaaaccctgtctctacaaaaaaatacaaaaattagccagacatggtgtcacatgcctgtagtcccagctacttgggaggctgaggtgggaggaccacttgagccgggagtttgaggctgccacagtgagccgaggttgcaccactacactccagtctgtgcaacagagccagaccctatgtcaaaacaaacaagcaggcaataaaataagataaaataaaatttgataccaatcttacctcaactaccattgtggcagagagaggctcaacagaagcatctgagaggcaggaggcctggatgggaggaaagaggggcagagtctcctgtggctcaatcaacgggaagagccgccctatgacaagattgattgggaagaggatgacagcagtatggatgctgaccagcagttcagaccaggccacagcaaatggacgcactgaaagaaaagcatgacatcaactttcatcttcaacaattaaaataatcgcaaagtcattcctctcctaggtttaactatttactgaggaagttaactacgtttatctagagataaaattatcctggcagtaaagaccatgttgtgttcctaatactgcttcatttgttaatgaatgagaacactgagaaaatttgttagagtattctaacgttagggcagtggaagaaaaatgaaggcacaatgtattagtctgttttcacactgctataaagaactatctgagactgggtaatttataaagaaaagttcttcatggctggggaggcctcaggaaactcactgtcatggcaggaggtgaagaggaagcaagaaaccttacatggcattacaaagcattacaaagcactacaaagcaccttacctggcattaacactttacatgccttacaaagcaaagcatcttacatggtggcagaagagtgacaggggaactgccacacacttttttttaatccccgagacggggttttgctgtcacccaggctggagtgcagtggtgcaatctcggctcactgcaacctccgcctcctgggtttaagcaattcaaccatcagatctcatgagaactcactatcatgggaaaagcatgggagaaactgcccccatgatccagtcacctcccagcaagtcctccccccgccccaacacagggggattacagttggacgtgagatttgggtggggacacagagccaaaccatatcacaccacatgattctgtttctttctaatcctgaaagtaagggtagtggagtttagttaaagtattgcatagtaggctgggcatggtgactcgtgcctgtaatcctagcacttcaggaggctgaggcaggaggatcacttgaggccaggagttctagaccagcctgggtaacagagcaagaccctgtctcaaaaaaaaaaaaggattgcttactacaaacaacacacatcagggctcatccatactttgctcatctctcttggcagtggtgctgtttatcttccagaacataacattgatgaccatgttgcagagtagcagtgtcatgcagcaagacagccgttggacccttgtaaactggttccagggatgccgagttgcaattgaaagccacagataatcctgggtgaacttttccacaatcatggaggaaaacagatgtctgaaaagagaaatcagaagaggaaatacatgagattttattctgaaagtgcaccagtttaagatgtgatttgcccagcaacaagcgacatagcaactcccaagcctctattcaacacctctgtgaataagctttcagatattttaattctttttttattttaaattcttttaccatcacccgaatgtgtccatgtaagattcttttgttgttttaggataaaaggttgttgaggataatttatatgctatgcgagtttaaaattaaaaatggttgttttagctttataagagttttgatgaattttttactcttcaaaagtttacattaaacttctgctcaaaatagtttggtaaattcatactctgagcactttctctactccaaatatggaggaactataaataatatataaaaagaaagaaccaaaaagactttgctgggcttaaacacaaaataaaccttttctgaggaagagaagcagaatgagaaaacaaggtggtcagagtgaggtagaagccacaggattactgagctccagacctggaggaaggtagtacaaaagtgggagtttgacttttgtacagtaactgaaactaaaaatgattcactgggtgcagaaaagggagggacaaagccaacttcattgctagaagccagtgttgagcctggagctcatgaaaggatacttgagaacaaaaaaacctctgtagggctacacatttatagtaaggaggtgagaaaaaaaggacagcttcatgaccaggaactaagtcaagagatccaaggctcatgacaagatctgcaatactcctagttccattaatttcattgaaaaataggagctccaaggtcccatataataaggcccagttctagactggagatgtgaagggttggaatgaaaacagtagcaaaaccagtcacgggtggtgtttgtggtggaaggggtggaagggatggtatgtgtgtgtgtgtggaggtgcagtggcagggagaggagtgggagggagagggaaagtaataatccagcccaaaagaaattaatttaatgggacccaggaggcagaggttgcagtgagctgagatcgcaccactgcactccagcctgggctacagagagactccatctaaaaaacaaacaaaaaaaggggtgtatataaacacacacacataacagaatatcatttagttttttgtttttgagacagggtcttgctgcgtcacccaggttggagtggagtgcagtggtgagatctcagctcattgcaacctccatccccctggctcaagtgatcctcccacctcagtggtgtgcaggtgcacaccactacacctaatagggcttagctgtatccccacccaaatctcatcttgaattgtagtttccacaatcctctcctctgtcatgggaggaaccaggtggagataactgaatcatggggtcagtttcccccatcctgttcttgtgatcgtgagcgagttctcacaagacctgatggttttataaggtgctccccacttcactgggcactcattctccttgctgccatgtgaagaaggatgtgtttgcttccccttctgccatgattgtaagtctcctgaggcctcccaagccatgcttaactgtgagtcaattaaacgtctttcctttacaaattacccagtcttaggtacgtctccatagcagcatgagaatagactaaatataacacctggctaaattttgtattttttgtagagatggagttttaccatgttgcccaggctggtctcgaactcctgagctcaagtgatccacttgtctcagcctcccaaagcgctgggattccaggtgtgagccactgcacctggcccatcatttagctttaaaaaggaaggaattttttttttttttttttttttttgtgagatggagtttcactcttgtcacctaggatggagtgcaatggcctgatcttggctcactgcaaccttcacctcccaagttcaagcaatccttctgtgtcagcctcccaagtagctgggattacaggcaaccacagccatgcctggctaatttttgtatttttagtagagatggagtttcaccatgttggccaagctatctcaaactccggacctctggtgatccacccgacccggcctcccaaagtgctgagattacaggtgtgagccaccgcacccggcccaaaaaggaaggaaattcttgcacatgctacagcatgaatgaaccttgaggacattgtgataaatgaaataagccagtcaccgacagacaaatactgtatggttctgcttacatgaggaatgtgaagtaatgaaatttatagaaatagaaagaatagttgccaagggttggaagggggagggaacaggaagttgttcaatgggtgtagagtttcagttttgcaaagtgaaaaagctctggagctctgttgcacagcagtatcaatatatatactactactgcactacacacttaaaaatggtgaagatggtaaatgttatgtgtttttaccgtaattttaaaagttgtaaaaacagtgtaaacatacacataaataaatatatagattgcaactcttctgccttaaaaaataactacatgcagcagtgattaagaatctatatgatggacacacaatgcatgaagatgtaatttgtatgacaacaatagcacaaaagagtgggaaaggaactgagctacaggagtgaagtttttgtatactattgaaattaagttgatagtaatccagctaggttttcataaattagaattttaattataatccccaggggaggcataaagaaaataatttaaaaatatatagtaaaagatacgacaaaagaatacggtagactagaaaatatccatttaacacagagaaggcagtgatgtcctctgggagattctatgccagtaggtgtgggtaactgttgaaccccatttgtgatggtgattaaaaaaaaggcagtgataaagaaacagaggaacaaaaaagatacaatacgtatagaaaacaaatagcaaaatggcagatataaaccttaccttattagtaattatatcaaatgtaaataggttaaactcacaaattaaaagatagagattggcagaatggaccaaaaaaatgcctaatccaactgtattctgtctacaagagacataatttagatatgaagacacaaatgaattgaaattaaaaggatgggccagtagtggtagctcacacctgtaatcccagcactttgggaggagaaggtgggaggatcatttgaggtcaggagttcgagaccagcctggccaacatggtgaaaccccatctctaaaaaaatacaaaaattagcaaggcatggtggcacatgcctgtatttctagctactcgggaggctaaggcaggacaattgcttgaacccaggaggttgcagtgagccaagatcaagccactggactaaaaagatggaagaaggtattccatgtaaacagcaatcaaaaaagggctggagtggctatactcatataggacaaaatatacttcaagacaagaattattactagagccaaagacattttattaaagggtcaattaagaagataaattcatctgtgctgtcttcttacaagccaagtggaagtgttgctagccagccatatagctgtcacaatgtttctgcttaggaactgctccacaggcagaagacaatgtattaaaatcttcaaagtgttaagggaaaaataacaaaaaatttctatccacttaaatagctaactatgagtcaagagtaaagatggacacacacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcttgaacccgggaggcggagcttgcagtgagccgagatcccgccactgcactccagcctgggcgacagagcgagactccgtctcaaaaaaaaaaaaaaaagatggacacacacacacttctcattagaactattaaaagagctacttcaacaaggagaaaaaagcccagagtaatgataagaaatacagaaaactggctggacgtggtagctcatgcctgtaatcccagcattttgggaggccgaggtgagtggatcaccctgaggtcaggagtttgagaccagcctggccaacatggtgaaaccccatctctactaaaaatagaaaaattagccaggcgtggtggtgggcgcctgtaatcccagctactcaggaggctgaggcaggagaatcacttgaatccaggaggcggaggttgcagtgagccgagatcatgtcactgcactccagcctaggcgatagagcaagactctatctcaaaaaaaaaaaaaaaaaaaaaaaaagtcgggcacggtggctcacacctgtaatcttagcactttgggagggtgaggcaggtggactgcttgagcgcaggagtttgagaccagcctgggcaacagagtgaaacgccgtctctaataaaatacaaaaaattagccaggcatggcagcgtgtgcctgtaatcccagctactccggaggctgagaaagaattgcttgaacgtgggaggcagaggttatagtaagctgagattgcaccactgcactccagcctggatgacagagcaagactcccgtctcaaaaaaaaaaaaaaaaaaaagacactaaaagaatacagaaaactaggctgggcacggtggccctcacctgtaatctcagcactttgggaggccaaggtgggtggatcacctgaggtcaggagtttgagaccagcccgaccaacatggagaaacctgtctctactaaaaatacaaaattagtcgggcatggtggcgcatgtctgtaatcccagctgctcaggaggctgaggcaggagaatcacttgaacctgggaggtggaggttgtggtgagctgagatcgtgccattgtactccagcctgggcaacaagagcaaaaatccgtctcaaaaaccaaccaactaaacaaacaaacaaaaaacaaagaatacagaaaactagaataaacagagaaattgatattaattatttaattaactgtgaaatatgaaaggaaaaaccttttttgtgcatctaaaaacaaaatggtaaaaccataacactagagagtaatttaaaacatgggaattgggagagaggttactcaagaacggttaaagcattgctaattctttgtcatgttcaggcagaagaaacgttattcttagaaaattaatatggagaaaaagtgtgttaaaaattaaaagtaaccaataaaaagaattagaagaggaagaagaggaacagaagcaggaagtggaaaaacaagaggagaaagaggaaaaaatacaatgtatagtttctaaaccagcaaagattaaaaatacaagaagtggtcaggcatggtggctcacacctgtaatcctagcactttgggagaccaagacatgcagatcacttgaacccaggagttcaagaactagcttgggcaacatggtgagaccctgtttctacaaaaatagttttaaaattagccaggcatggtggcacacacctgtagtcccagctactcaggaagctgaggtgggaggatcacctgaggctggcgaggttgaggctacagtgagctgtgatccatgtcacagcactccagctggggtgacagagcaagaccccatctgaaagaaacaaccaaccaaccaacaaaccaagaggcagagaaccttaaaaaaaaaaaaccaaaaaaaactacaaaacctgtcaatttgacaatgtggaaagtagataaaggaaagagaatggattataacaaataatgcaaaataatatggtaaattaagtccaaatggattggtaatcatggttaatgtaaacatattaaactcatgtattaaaagagattattagatctggttttttaaacatccagttatatgttgcttgcaagacataactctaagcaaaaccataaaaagggctgaaagtaaaaagataagaacaaacaatagaaataatatcagtatgtcaactttctttagttaatataaaatggaatttaagatacaaagtgtcaacaggatcaaagggagacctatataataaaaaaaaaagtatccagaagaaataacatacacttaaatgctcctaataaacatccaatagacatataaaatatgtctatacggtaaaaacttacataactgaaggagaattaaactcacagtctttcctctattggaaacacagagattaaacagataaaaaatcacatttctgcaacaaaaatgagtatgtttgaataaatatgtctatatatgttttaaaaatactagaactttggatgcaatggtatatgcctgtaatcctagctactcgggaagctgaggtgggaggactgcttgagcctaggtgtttgggaccagcttggcaaacacagtgagaccctatctcaaaaatcaaaacaaaacaaacctagaactgtatcaggtctagggaggggaaatagtattcgctaccccttaagttttggtgaaggagagaaaatttctaccagtttattcctatacacaagcaacacacaatttaaaacatatatttttggtttgttttttagagacaggatctcattttttttttcccacttcttgctgagagtccatgatttttagtttcaagacttatttgttttctctgttttgttttgagatggagtcttcactccttcgcacaggctggagtgcagtggcgtgatctcagctcactgcagccttgacctcccgggttcaacttccctgcctcagcctccccagtagctgggactacaggcgtgcaccactgcgcatggctaacttttgtatttttggtagagaaggggttttaccatgttggccaggctggtctcgaactcctgacttcaggtgatctgcccacctcagcctcccaaaatgttgggattacaggagtgagacaccgtaccttggcccttctccttgaatctgattttcaaagttaggacataaaaggctaaagcccctacttagttctgttgaactgcccattctggagggagacagccacccctgtgaaaaatgccactctcttgaggttgccacgcagaagccatacataggtgctttgttgacagccacagatgagctctcagttgacagccagcgccccctgctgaccttgtgagcgaatcatttttggaaatctaacacagaggagcttacagatgagtaacagacccagccaggatgaaagatcccaagggaaaactccccagccatggcctcactgaatttctgacccacaaaaccaggagaaaagtaacatggttgttttaatccactcagttttgggagtaatttcttatatgccgcaattgtaattggagcagatcttaacaaagaaatacacatttcttgtttgttctgggagtcaagtaccagaagaaacagttccatgtttttttgcctttaggcattttaatgtaaggacgtggtgtttggttgatagagccactgaggctggagcacagtggctgtatctcggctcactgcaacttccgcttcctgggttcaagccactcttctgattcagccttccaagtagctgggactacagtctcatgctaccaagtctggctaatttttgtactttggtagagatggggttttgctatgttggccaggctggtctcaaactcctggcctcaagtgatttgtccacctcggcctcccaaagtgctgggattacaggtgtgagccaccatgcccggctaggacatggtgtgtgggcctcttgcaatcatcttgttcccatgaggaaaaagccgagagccgtaatattgaaccagaaagctgaaggtaagaaggaggtcagatagcagaggtatattctcctaggaatattctcatctttagcattcaggagacatagaaagatacatggatacctagaaagatacagaagttgatacgtatattataccgttctcctggtctgtgaattcaccagtacattgctttaattattttggtttactaacatctttgcattttttgagatggagtttcgctccgttgcccaggctggagtgcagtggcaatcttggctcactgcaacctctgcctcccaggttcaagcagttctcctaccttagcctcccgagtagctgggatcacaggtgtgcaccaccacgcctggctaatttttgtatttttagtaggtcttgctatgttggctaggctggtcttgaactcctgacctcaagtgatctgcctgcctcagcctcccaaagtgcagggattgcaaacatgagtcacggtgcctggccagtttactagtgtctttgaaagtcagttgaaggctacagccctctaatactttcctttatttttatattttgttctcataaatatttgtatcatcgaagtagtggtatcctttttatattccattgatctgagtgattcttttattcctagatatcttagtaaatttataaatgattctctaggtaaacagtttcagaaaataagggcaatatttataatttttatacttcgaatctctttttgtcttccttctgatttttaaggtaatggttacaccagttacaaccacaacagtaatgcttatgtatgtttgaaataatacattaataaaatgttaatttgcattaaaaacaattcaatcgtgaacaattcaattaatagtgaacatcaatattcactgttaatagtaattttccaacagtacctaaaggaaaagagctctctctttgaaactgggatgaagacccggtcaagctcacagtctccgaggtccacagccagccagcaattgcacaggaaatgccacttcctcttaactgccatgtcacagacaattacctggctgacatacctatagtaaaatgaagataaccacattagggagatgggcttgaatcagttgtctgtagtaagacgtaatctcagaccattagtaaactgtccaagtaaatgaactgtttcattgcaaggcaagaactaaggaaaggaaagaaagttgaggccagacatggtgatgcacacctacaatcccagcactgcgtgaggctgaggcaggtggattgcttgagctcaggcatttgagcacagcttgggcaacgtcgcaaaatcccaactctacaaaatatataaaaattagctgggcgtggtggtgtgcacctgtagtcctgagctacttgaaaggctgaggtggaaggattgtttgagcccgggaggtcaaggctgcagtgagttgaaattgcaccactgcattctagcttgggtgacagaatgagactctgtcaaaaaaaacaaaaagaaaagagagtagatcttatctttcccttcccaacttctaagggagttcatgtaccagacaccagactgcaaacctttctcacctatgaatagataagtatgtatctacacattttataacctttctctgtcccatatgtgacagtggcttgccaccttttcaaatatcccatctgcctttcatcatcagggggcataaatgggttgtagtctttatcatttacattaatgacttctcactctacttagtctcatctccgcttcacaggcctcatctccacttcacagagccataggccctgagagctcatccttttcccaaccagtgttttatcactaatttctctgctaacttcagccgttcacacccctgtcctctgggacacctgattattcaacctgtttgatttcacctcacaactattcggcaaacctcctcctttactgtaatgatgctattttccccaagggtctgtgtttgtcatgaaaccacttaaatttctctcgtcaaaatctttttttttttttttttttttttttttttttttttttttttttttttgagacagagtttcactctcttgcacaggctggagtgcagtggtgtgatcttggctcactgcaacctccacctcccaggttcaagcaattctcctgcctcagcctcccaagtagctgggactacaggaaggagccaccacgcccggctagtttttgtatttttagtagagatggggtttcactgtgttatagccaggatggtctcgatctcctgacctcgtgatctgcccgccctggcctcccaaagtgctgggatcacaggcatgagacaccatgcctggccaattcaatgtattttgacaaacgtttatacaccagcaccatcaaaatatcacccccaaaagctccctatccctccttccagtcacctcctgccccctcattcctggccttaggagaacaatgatctgctgtcctctgtctttatagaatagttagccttttatggaattttatgtgtgtggaatcatatgctctctctctatatatatgtatttttttttttttttgaggcaggatcttgctctgttgcccaggctggagtgcagcggtgcgatcttggctcactgcaacctccacctcttgggctcaagtgattctcccgcctcagccccccaagtagctgggagtacaggcatgagccatcacgcccagctaatttttgtatttttttgtagagacagaatttcaccatgttgcccaggctggtctcaaactcctgacctcaagtgatctaaccaccttggccccccaaagtgctgagattagaggtgtgagccactgtgtctggcctatacattctttatgtacagcttctttcactaagcataatttaaaaaaattcatccacgtagtcatatgtaacaatcgtttccttttcgttgagtagtattacattgaatcaatacactaacatttgtttattcattcaatagacatttgtgatgttttctgttttgggctactaataaagctgctatgaatatatgtgtacaggtcttgcagtggacacatgtttttgtttatcttgggtaaatacctatgagtgtgatttctgggtcacatggtcagtgtatgtttaacttcacaagaaactggcaagctgttctctgaagtggccataccattttacactctcactaggggcgtgtgagtgtttcagttgctccccatcctcccctaaacttggttttgtgagaattttttttttttttttttggagatggtctcactctgttgccaagttggactgcggtggcaccatctctgctcaacgcaatctctgcctcccaggttcaagcaattctcctgcctcggtctctcgagcagctggggtgacaggcatttaccaccatgcccggctaatttttgtatttttagtagagacagggtttcaccatgttggccaggctggtctcaaactcctgacctcaagtgatctgccaacctcggcctcccaaagtgctgggattacaggcgtgagccactgtgcctggccttttgtgagagtttttaatttaagccattctgatggatggctagtgctgtcattttcatttactgatgactaaccaggttgaacatcttttcaagtgcttactatacattattcacttttttaaataaaactggaaggatggtttacaagctgatttgtgcatactggaacagaatggaagcagcaaggaagttattaggctctaccagcccagtggctggtatgtctagctagggggaaaaatgtattttgctaacaaatttagggagaccatatgctctttgtgggtgggcaacatgtggcaacagattgagtgcctgagccttaagacttctacttcatttttctcttttttcctaactccaaggaaccagtaatcctcattcttaattaattgtatcatctactttctctagcacctctcctaattctgggtgctgctcaaggaagatactgaatcattcaaacctaacacgttaggttcaaggactttatcatcgtctagttatttctctaactccttaggcacatctcatacagtaattctttctccttccttaagatcttgacttttttttttttttccttccctccgagacagggtcttgctgttgcccaggctggtgtgcagtggtgcagacatgctcactgcagcttcaacctccgaggctcaagttatcctcccacttcagtctcctgagtagctgggattataggtgcacacaaccatgcctggcgattttttttgaaattttttttgtagaggtggggtcttcctatgtagctcaggctgttctcaaactcctggcctcaagtgatcttcctgccttggcctcccaaagtactgggattacaggcgtgagctgctgcgccctgcccttaagctcttaaatttgactcaaagtttgactgtcagtagacagttgtttactaaagttagtctttaaggatattttttcatatttagaaatacttttaatttgtggcactttcaggcaatatttcattggtgttatttgctgttcacaatcatgacatttaatgaaaatgagattagagaaaacaaaacatctattattctactatccaaaaaaaatcacattgttaatctctcacacttctttccagggcttattctgtgtagacagctttgaaactgaaatctaatagtcatttgttactatttggctcaaagctttactgtgatttattgtggtgatcttctttcttctctcttggatccacaaagcagcagcaacagccaacaggatataagtactcaccaggagggactgacgccagaattgtcatgccagagccgaaggctgtgcaggttccctagagaggtccaagtggtgagaaggaagacatccaggccccctcgttcaaagactgtcttctgggggtcacagaggtgatggggctcactccgtccctctgatccatagagggtgatgacaacctacaatgagacagggaaagataaaatataaggaattttaacacaattctttgggtttatccctaaggagaaagacgaagacatagaaaactatttagatcaagtctttcggatcttagacaagcatagataattcttcatatatgcagtatagatatattttttctgacatgaagtcttgctctgtcacccaggctggagtgcagtggtgtgatcttggcttagtgcaacctctgcctcccaagttgaagcaattttcgtgcctcaacctcctgagtagctgtgattatagtcatgggccatcacgctcagctaatttctgcatttttagtagagaagggttttcaccttgttggccaggctggtctcaaactcctgaccttaggtgacctccccaccttggcctcccaaagtattgggattacaggcgtgaacccccatgtgcggcccacatgtacagtttagaactagaaaataccaatctctagtctcttttaaagtgctattggttgccaggatatcaccaactcagagtgtgtctcatgtggcagaagacacaaggcaatgtgaaaaacatttatttcattaaccttagctgttgtagcagcgcttcttcgatatccggtgtagacctgaataaggtagtgaaattgagcgctggggtcattatcagccaggacagtgaccttcacctgcaagaaaagcagaaccatgcaacttactaggcctccacttggtatagttcctgcctcctccagctgaggagcaggaggatgaactccggcaggtgtctggcagccctgcagaaagcagggctgaggtgtgggcagcagacagacacatgagcagacctaagtcactaaagtggggatgaggcctgaacctccagggcctgtgcctctcaagtgaaacagtcatagaatcacccgatcaggtcttgggcctctaaatccttccacctccttcccacttaggtacagtcaccagataacagagaatacccagctaaatctgcatttcagataaactatgaataatttggggcacacttacactaacgatgcactgttcatttaaaatgcaaatttaactaggtagcctgtatttttgtttactaatgctgacaaccctacacccagggcaacaagaagtgaacacttggcgtattctagaatttccaagtgcaagaaaacataggaagaacaaacacatggaaagaagaggctgtcaaaagatttttgttttaaaaaacatgccatataaatttcttgtatattatagttatattcttattttttgagacggagtcttgctatgttgcccaggctggagtgcagtggttcattcttggctcactgcaacctctgcctcccaggttcaagtgatcctcccacctcagcctcctgagtagttgggactacagacatgcaccaccacagccggctaatttttgtatttttagtagagacagggtttcaccatgttggccaggctggtcttgaactcttgacctcaagcgatccacctgcctcggcctcccagtgtgctgggattataggcgtgagccacttcacccagccagttacattaagttacaatttgatttacatataacttttttttttttgagacagaatctcactctgtcggccaggctggagtgcagtggggcaatctcgatctcagctcaccgcaacctctgtctcccgggctcaagcaattctcctgcctcagcctcccgagcagctgggattacaggcacatgccaccatgcctggctaatttttgtatttttagtagagatggagtttcatcatgttggccaggctggtctcaaactcctgacctcaggtgatccacctgcctcggcctcccaaagtgctgggattacaggcgtgagccactgcacccagccaagttacatgtaactttcatatccaatgtataaagtaagataaacttgcatttaactttagttaagctctctaggtcttttcttttctttttctttttggagactgggtctctgttgcccaggctggagtaaaatggcacaatagctcactgcagcttcaaggctcctgggctcaagcgatcttcccacctcagctgcccaagtagctgggactacaagcatgcaccaccatgccaggctcttttttttttttttttttttagtagagacaaggtcttgttatggtggccaggctggccttgaactcttgagctcaagtgatcctcctgccctggcctccccaagtgttggaattataggcatgagccactacacctggctagtgttttcttttggctcattcctgtcctaaaaggagtcctgcaaggtccaatcttggaaccaaaggaaaaaaaaatagagagaaaaagttctcaggtcttgagtcagcagacacgaagataaatttaagaaaagtttcacttgaatttctatgcctcccagtaccaggcttcctgctgcttttgacgaaggtgttttttccttcatcttatttaattactcaaaacatcatggcaaatctgttgaaatcaaagtctcattaccttctgcatatctgcttgatcctttttccgagcccacacaactgtgatcacataaaatcctaaaaggctggccagcagtgacaccccaacaggattgttggtcacgcgaaggaacagtttgatcgtgtcttcaacattcacggtcctgggcacgacaaagaagtcgctggcaaagaaggtcaggtggttacagagacactgtgtcctcagaattgtgctctgtggcccaacctggaattagaatcaagacgttgattctagtcagacagagtgctaaggaggggacagacataaaacaaacaccagcaatttagagatggaaagaggtatctggttctctcattcacagctggtgatggcgtaaattggtataaccaatgtggaaagtaatttagcaacatctagtacagctgaagcagaacaaactctttgaatcctgcaattccagttctgagtgtatacatgttctaggggaactgtgcacatgtgtatgaagatatatgaaaaggaatgttttgtcacctttgtctataattatcaaaaataggaaacaacttacatgttcaatagcagaacatacaaatgaacaagtacataagtaagcagaggcaaactgattgaattctatacagcagttaaaaatgaatgaatcagcgggtgtggtggctcatatctgtaatcctagcactttgggaggctgaggcaggtggatcacctgaggctaggagtttgagaccagcctggacaacatggtgaaaccccatctctactaaaaatataaaaattagccaggcttggaggcgcatgcctgtagtcccagctacttgggaggctgaggcaggagaattgcttgaacctgagagacagaggttgcagtgagcccagatcacaccactgcattccaccctgggtgacagagcaagactctgtctccaaaataaataaataatacataaatataaaaattttaaaaaatggatgaattagaggtagatgtatcaacatggataaatgctaagtgaatacaacaagagatatgtacagtataatgccatttgcccaaagcctaagaagcatgcaaaacacttatttatctattcattgtcagtttccctctccagaatgtcagttcatgaggcgattgtcttgttcactgctgtgtctctagttcctagacttgggcatggcacgtagaagacactcaataaatattcggtgaaagaatgaattcccccctcaaattcaggccagtagttaccctttggtggaagggaaggaaggagagagactagagagggatactcagagggcttcaattattcatgagtgttttattatttaagaaaatatgaagcagagcaaaatactaactttgataaagctgaatgtgcattcaatgttttttattattctttatggctttccatatgttggaacatttctgcataatatttaaaaatatgtcagtaggtgattacatggaagctaccaattctgtgtttggtttcgtgggtgaaaagcctccagtactgtcattatgactacttctttccatggcacagaattaagtcctggaggcccaatctagtctgcctttggaagaactcttgcgctgtatttggggcagctcaattcctttcatggagtccaagcacttcagcgtgcttcaaggaggtgggaaatatccgatgccttctgcaatcaactggtctgtgctgtgagaggagaaaagctctcaagcttctctactcaaagtatggtttccctaacaagcagcactgggatcagctggaagcttgttagaaaggcctgaccagagctactgcttcagaatctacattttaacaaactgattatagatttgcttgatagccattgtccagctatgactgcctgaggctatgaatggtgcagatgccttcctaagaatcctctctctgtcatgcctgtaattccagcactttgagaggccaaggcgggcagatcacctgaggtcgggagtttgagaccagcctgaccaacatggagaaaccccatctctactaaaaatacagtaattaggccgggcacggtggctcacacctgtaatcccagcactttgggaggccgaggcaggcggatcacgaggacaggagatcgagaccatcctggctaacacggtgaaaccctgtctctaataaacatacacaaaattagccgggcgcagtggtgggtgcctgtagtcctagctacttgggaggctgaggcaggagaatggcatgaacctgggaggcagagtttgcagtgagccaagatcgcgccactgcaccccagcctggccgatagagcaagactggtctcaaaaaaacacacaaaaaaacaaaaaaaaacaataattagctgggtgtggtggtgcatgcctgtaatcccagctactggggaggccgaggcaggagaatcgcttgagcccagcggggcagaggttgcggtgagccgagatcatgccattgcactccagcctgggcaacaagagggaaactccctctataagtaatcatcatcatcctcctcctcctccttctggcctcccaaagtgcaggagggaggattgcttgagctcagaagttcaagaccagcataggcaccatggcgagaccctgtctgttcaaaaatctaaaacattagccaggcatggtggcacatgcctgtggtcctcattacttgaaagtttgaggcaggcggatcttttgagcccaggaggttgaggctgcagtaagccgtgatcatgccactgcactccagcctgagggacagaatgagatcccacctcaaaaaaaaaagaaaattatctttccttctctttccaatctagatggcactttctcagctctttttagaacagcttgctgatttgcaagaccttacaccacattctttgagcaaccaaaccaggactttcatcaggcaggatctcacagaatcacgagtgtgcaaatataatagtgctggtttaaagcagttggacaccaggaacaaggtgataattacaaaagtgacaacctgtcctcacctggcctggaacgtaaaagaatctgagaatgtatttcttgagctatgaaagttctccttcgtttagcaagaggtttcattttacccacccacaacatatttaatacttgtagaattttatggcttccacacgctattttatccacacttgtcagatccaccctggactgtgtttgagaaagaaatcacaaagataaagcacaaagctgctcctgcttcgaagaggcacacttgccctgcccaccacacacaaccctcctccctccttttgcccaggcagagttatttcaaaccacctgattatttttctttctgggctgccccaaatgagataacggatgcattgggcttaacagtagctatggcagaagagaggcccaagaagcggctcagtttcttacttggcatccggcgctgctccatgtctggttgtggatctcccagtagtaacactgagtgacggcggtgatgaccgagaccaagctgggtgtctgctgagcaccctcctgcctctcactcagcacagctgttatatagtaggtgccaatcccgtgctgcagatgctctggattcagcacccacgtgtactcctcatcttagaacaaagaagagtgcttacttgtatatcaaatggaacaaaaacaccaatgaacctctcttctaaaggatctattattaatattttacaaatgagaccatgatgaaactagagtcacaaatgatttgaaagaaaatgaccagtgatacaaccctgggctctggattactactgttccagtaaagaactacagtcttttggccaggtgtggtgactcacgcctataatctcagcactttgggaagctgatgcgggcggatcacttgaggtcaggagttcgagaccagcctggtgaacatggtgaaaccccatctctactaaaaatacaaaaattagtggggtgtggtgatgtgagcctgtaatcccagctactcaggaggctgaggcaggaaaattgcttgaacttgggaggtggaagttgcagtgagccgaaatcgcaccactatactctagcctgggcaacagagtgagattttgtctcaaaaaaaaaaaaaaatatatatattcttctggtatgtgaacatgtgaacatttaggtctaatgatttagaatgtattacgaggtttagaaaaatgaaatgagcacatatctaagttagcagatagaagactaaggtaacaaaccccagggtgaagcaaacatagagatagggcagcttcaggaacaaagcccaggactgcacgctagggaccggaggtcgggcctggctctgtcaccagctggctggtaggggctaaggtgagtcatccagtctctctgggcctcagctttctcatctttcaaatagtcctgtctctcaaaaaaaggttcctgaaggccccttccggctctgaatgacatatcattgccaagatcaccaagaaaaactgagtccatggccaggcgcagtggctcaggcctataatccaagcactttgggaggttaaggcaggaggattatttgagcccaggagtttgagacctagcttggcgaacatggcaaaaccctgtctctactaaaaacacaaaaaattagccaggcatggtggcatatgcgcctgcagtcccagctgcttgggaggctgaggcatgagaatcgcttgagcccaggaggcggaggctacagtgagtggagatcgcaccactgcgctccaccctgggcgacacagtgagcctgtctcaaaacagaaacagaaacaaaactgagtacacctttggaattgggaaagggcccgttggtaatttccacagattctgtagtgggcagcctggtagtgagcattgctgcctcggggactttgcctaaaagcaagaacttagaagtgattgttcctgtgtgagtggtgcccatgcgagagccagagaaagttctttccagtatggaaggtggtcatgacgggagactgtagcatgctttctccattcagatttttcccaacgtaaaaataaatacagaagtgtagctcttattaagacttttcagtactatatttaaagttgatacccacagagcatggttttgatcaagtatatctgggcactatttatatatatcaggaatttttattttttagagacagtgtcttgctctgtcacccaggctggagtgcagtggtatcatcgaaactcattgtggctttgaactccttggctcaagcaatcctcttgcctcagcctcccaagtagttaggactacaggtgcacgccaccacgctcggctaattttttttttttttttgtggagacagagtctcgctctgttgcccaggctagtctcaaattcctgggcttaagtgatcctcctgccttggcctctcaaagtgctggcgttacaggggtgagccactacaccaggccagacatttttaactgtaatgttatgtctcagaaattcttaacttttctaaactacaatacattcattctgattttataccaaggcatactgagatatcatcaggcctttcttcctcaaatctaagattagaaataaagttgaaatacataggacatatttcatatatagtcatctacaatatataaatgtgaagtatatttaactcatggtgctgtgagccttacttctgctgtgggtctcaacatgttattatgaaaatcttcaaccatacaaagaattttacagggaataaccatataaccattaactagattctacaattaacatcctactaagtctgcttccttacatacatatccttatccatcctataatccatctttaaaaaaaaatgattttatggtcacgtgtctacacatgtggtaaaatcacacaggactcaatacacacacatacagaaatgtgcttgtaaacctggtgaaatcggaataaaatcagtgattgtattaatgttattttctggttgtgatatactctagttatgcaagatactaccattcagagaaactggatgagaggtatacaagctgtttctgttcttttttttttttttgaggcagggtctgtcacccaggctggacagcagtggcacaatctcagctcactgcaacctctgcctcctgggttcaagtgattctcatgcctcagtctcccgagtagctgggattacatgtgtgcaccaccatgaccagctaatttttatacttttaggagagatggggtttcaccgtgtgggccagcgtagtcttaaactcctgacctaagttgatccacctgcctctgcctcccaaagtgctaggattacagtgggatttcaggcatgagccactgagtgcccagcctgtcttttttttttttttttaagacagtcttgctctgtagcctggagcgcaatggtgcgatcttggctcacggcaacctctgcctcccaggcttaagcaattcttctgcctcagcctcccaagtagctgggattacaggtgcccgccaccacacccatctaattttttgtatttttagcagagatggggtttcatcatgttgaccaggctggtctccaactcctgacctcaggtgatccacccgcctcagcctcccaaagtgctggggttacaggtatgagccactctgcctggcctgtctctgttatttcttataactgcatgtgaatctacaattatctcaaaatgaaaatttttttaaaaaagaaaaaaaagtggccacatgaagtagctcatgtctgtaatcccagcacttcaggaggctgagacaggaagattgcttgaagctgggagttcaagaccagcctgggcaacatggcaagaccctgtctccactttttgagacggagtctgtctctgtctcccaggctggagtgcagtggcacggtgtcagctcactgcaagctccgtctcccaggttcaggacattttcctgcctcagcctcccaaatagctgggactacaggcacctgccaccacacctggctaatttttttgcatttttagtagagacagggtttcactgtgttagccaggatggtctcgatctcctgaccttgtgatctgcccgcctcggcctcccaaagtgctgggattataggcgcaagccaccgcgcccggcccacaaaattttttttaagaaattagccagatgtggtggtgcgcacttgtagtcccagctacttaagaggctaaggcaggaggatcccctgagcctgacagtttgaggctgcagtcaacaatgatggtgccactgcactacatcctaggcaaaaagaaatcaaagtaagtttctgacagctgattgggttttacctttttgccacaccttatcctttggaagggtgatgttcaggtggaagtgagtgcagttaggctgatactggaaccccaggtagagtgtcattaaaaggggactgtcaggatctatgctcactatcaaggatttctccaaggaagtgacgttcactgtgattgtaagctgatgtgtgctcatgttgaggctggtgggatgggtttccaagctaacatttctccagagcatgatctagaataagagacagttaatcattataatggtccatccattgatgtctttcaaaatcctttatattgataaggtaaggaaacgtcctagctcttttttttttttttttttttgagatggggtcttgctatgttggccacgttggtcttgaactcctggtctcaagcaatcctcccgcttcagtctctcaaaatgctaggattatatgcatgagccactgtgcccagccaggtcttcctcattggatgttagtagctaatactgctggggttaaggataagtacatagtcccagacctataacacttcttattcttcttatttttgagaccaagcattactctgtcacccaggctggtgtgcagcagtgcgatctcagctcactgcaaactccacctcctggattcaagctattctcctgcctcagcctccagagtagctgggataacagccacccactgccatgccagttaatttttgtatttttagtagagatggggtttcactatgttggccaggctggtctcgaactcctgacctcaagtgatctgcctgcctcagcctcccaaagtgctgggattacaggcatgagccactgcgcccagccctttaaaacactttttctaaggataaggtgtatctctttgtaaaagttcctaagatgttaataacaaaacaatggcactgccatcaatctaacataattccctttaagttgttgcatccttccatcctgttgcagaatatcccattctcttctattttattccctaagaatcagttcctacctcaatgtcctccattaaatcatggacttggagcaatttacgattagcgcttagtaacacacttccaatgcttccaacaatgtttctgttgtccaaatccttgaagggattgaaagctagtcctgttatctaaagacaaagagaagcccagttttatccattgctgaaatatttttaagtgaccccactagaaagatatatcatatatacatatgtatatatgtgtgtgtgtgtgtgtgtgtatatatatatatatatatatatatacatacatacatacatacatactttttttttttttttgagaaagagtcacactctgtcaatcaggatggagtgcagtggcacaacctcagctcactgcaatctccacctcccaggttcaagcgattctcctgcctcagcctcccaagtagctgggactacaggtgcacaccaccatgcctggctaatttttgtatttttagtagagacagggtttcgctatgttggccacgctggtctcgaactcctggcttcaagtaatccacctgcctcagcctcccaaagtgttgagattacaggcttgagctatcatgcccagccggatatcatatattaaatattgggatgtgccccctactaataccgcaaatgaaataacattccccatttataacctctatgagaaacagtaaattaaagatgaattatcgttgggatccccagaattattatttttaatctttatatctagaggattctattttactaggaagtaactgttctgctcttcaggataaggcaacaatgctacttgtatttgtcaggtaactgctgaaaggaatacaatatattgatatgactgggttggtatactgagtcaataattatttagatagtctcagctttttgtaaatagtgcagaggctgggcatggtggctcacacctgtaatcccagcactacgggaggctcaggtgggtgaatcacttgaggtccgtagtttgagaccagtctggccaaaatggcgaaaccccgcctctactaaaaatacaaaaattagccaggcatggtggcccatgcctgtaatcccagctacttgggaggctgaggcaggggaatcgcttgaacctgggaggcagaggttgcagtgagccgagatcacgccactgcactccagcctgggtgacagattgagactccatctcaacaaaacaaaacaaaacaaaacaagacaaaacaaaacaaaacaaaacaagaaaacaaaaaacacaacaacaaaaaacaaactgcagagttgaaatcaattcaaattacaacacaaatttagttaaatccagaaatctgtttaatgttcccaacttctacagtggatcatttttaagaggcctctatccctgccagtgtaaaataaaaatgaatgctacataaactctctcatctgatctggtctgttcagtttacatttcatgatacattactttcacccaaatgcctacatggccatcagatcccattttcattctgatcacaatcaatttcacactcacttggacattaactcctggatgtttattcaagagctccttcaaagctaaagccgacggaaagcctagcctcacaggggctgggtgacccagagtgtaagagctcagcggtaaagttgatatgttttgtctaatgagaaaagttaaaatggaagtcaatttttgtgtgtcctctgaaagtgaaaaacacagtgaaactctccccgttccttcttcccattaacctgctcagcagcagagtagcattggcagaggtcaaagtcactgaagactcgggagactggttctgctctagaaatgcttccccgatattcccaaactccaccaaggacatttccaggatgtcttctacctgcatggaaaggaaaacagtgtgtgacttgtaaaacctcagtgtcttatgttagtaaaataatgttttggagaagattggaaggggaattttcacagtgttgtaatgaagggtagtattccttagagaggaccttggaatctcacagaaagtacttgcaacctggctaaagacttagcatcctttgaaccaaactaagagggctggccaaggaaatatgcctttgccccatcatataattgccctagacctgctcacgatagagtttttaaatgacagctttattgaggtaactttcacatatacagttcatccactcagagtatataatttaacgttttttagtatattcacaggattgtgcaaccatcaccacaatctaattttaggattcatcctccctaaaataaacatggtggccgggtgtggtggctcatacctgtaatcccaacactttgggaggctgaggcaggtgggtcacttgaggtcaaaagtttgagacctacctggccgacattgtgaaaccctgtctctactaaaagtaccaaaaattaggcaggcatggtggtgtgcacctgtagtctcagctacttgggaggctgaggtggaagaattgcttaaacccgggaggtggaggttgcagagcacccagatcacactactgcactccagcctgggcaacagagcgagactctgtctcataaaataaaataaacctggtacccattagcagtcactctccattccctcatccctagtccctctagctctaggcaacaacgaatctactttatgtgtctacagatttgcctctttgggacatttcatataagtgaatcacaacatacagtcttttgtgataggcttctttcacctggcataatgttttcaaagctcatgttggagcatgtaccaggacttcattcctttttgttgctgaataatattccattgtatgaatagaccagattctacttagccatccattagatcatagatgtgtgggttatctccactttttggctatttagctattaaaccatgctgctacaaacttgagtgtacaagtttctgtatggacatgttttcaactctcttgggtagacactaggagtagaattgctaggttacatggcgattctattttttacattttaagcaactgataaattgttttccaaagtggctgcatcattttacaatcgaacaatggatagggtggcaagttctctgcatccttgccagtacttgttattttctgtctttttgggtgtgaagtggtatctcattttagttttgatttgcatttccctaatgaccaatgatgtcgagcatcttttcatgtgaatagcaaacataacctgttgagtgtttgctttatgccaacactttcctaaattctttttttttttttttttttttttttttatggaatctcgctctgttgtctgggctgtgtgcagtggcatgatctcgattcactgcaacctctgcctcccaggttcaagcgattctcctgcctcagcctcctgagtagctgggattacaggcatgtaccacaatgcctggctcatttttgtatttttagtagagatgcagtttcgccatgtgggccaggctggtctcgaactcctgacctcaggtgatctgcctgccttggcctcccaaagtgctgggattacaggtgtgagccaccgggtccagcccctaagtccttttcacttgattacagcactagggagtcttggctcactggtggggtggggagggagaccttggagaaggcatggcagaggagtttcttctgcagcagaaacttcagcaagattatctttaaaggtctggggagaggctgtgatacctggacctgtcaagattaaaatgcttctaagcagatctggccacctgcatatctggcacctaccggctcagtatgacgcttggattccagccaacttccttctccagctttggtgacattgttgagggaatgaaaggggcagacagttggaggaactttgaagcccagactgttgttgttctgaaatgggatcctgagtaactcctcactcaggtaaataagggaattgatgagattaacctgggaggattagaaagcaaacatacacccttgaattgtttgctttttttttttttttttttttttggtgacagagtttcactcttgttgcccaggctagagtgcaatggcgtgatatcgactcactgcaacctctgcctcccgggttcaagcaattctcctgcctcagcctcctgagtagctaggactacaggcatgagccaccatgctcaactaattttgtatttttagcagagatggagtttctccatgttggtcaggctggtctccaactcctgacctcaggtgatcttcctaccctggcctcccaaagtgctgggattacaggtgtgagccaccacgcccagcctatgattgctttttaaaattttacttttaagagatggggtcttgctctgttgccccgtctggagtgcagtggtacaatcatgcctcactgcagcctcgaacttctggactcaagcaatcctccttcctcagcctccccagtagctaggacacaggtgggtaccaccacacctaatttttaaaaattttttgtagaggcaggggctcactgtattgcccaggctggtctcaaacacctggccccaagagatcctcctgtcttggcctcccaaagtgtttagattacagacatgagccacacacctagcacatgattattttcaatttgcatacttcttattagcagcttaatattcgttatacatttcaaatgcattttataaaaaaaaagttacaatttgacagggaaggagaatatattatttcatataacctataagggaggattcatatttcatgttattctgacaaactgacaattctttttgagtggtgagtagaccaaatatccaattaataccatcagactaaaaaaaggaatgaagaaaagaccaatgctgagttttttgtctttttaatttcagacagagtgtggctctgtcacccaggctggagtgcagtggcagagtcttggctcactgcaacctccaccttccgggctcaaaccatcctcccatctcagcctcccaagtagctgcaactacaggtgagcaccaccacacccagttaagttttgtatttttgatagagacagggtttcaccatgttgcccaggctggtctcgaactcctgggctcaagctatccgcctgattcagcctcccaaagtgctgggactacaggtgggagccaatgtgttccactgaatgccgacagacttctaacaaatgcatcagcaaggcagtaccagctgattaatcaacaaatgaacataaacacagtatatccaacaatgtcactactgatcaatttaattcataactttccagatttaaaggtaaaaaaatatgcttgctaaaatttaaatacagtctttataatgctaagcttggcataaggcacaatctccagattctctttcttttttttttttttttttttttggagacacagtctctcagccacccaggctggagtggagtggcgggatcttggctcattgcctctgcctcctgggttcaagtgattattgtgcctcagccttccaagtagctgagattacaggtgcccgccaccgagcccagctaatttttgttttttcagtagagacgggttttgccatgttgcccagtcaggtcttgaactcctggcctcatgtgatccgcccgcctcggccttctaaagtgctgggattacaggcgtgagccaccgcacccagcctcagattctctttttctgttttccgcttttccctctctcctaccttcttccctcccagtcaccctccacttacctgagctggcttagaaaatcttggggttaaggctgttagtttctggaggaactcacaagcttcctgtagtttgttaagagcttgcaaaccatgaactgctctgctgaagttccctgctatctcatctatgacctattgggaacaaagaagttgtcaaaattactcatacaaaattactgtactgtagtagtcagggagattattttcatccaagttgaccttgggtaactttataaaccctatgaaccacagctctctaaaacagtgattactttcagaagcttttctgcgagtggacagaatttatttctacttcttccatacgatagagaaaatgaataacgagattatataatgattgctccaagggcaaatgagtctggaaataagatttatagcagtaactttaagtgttaaggccatgaagatgagggaaacttggaaattaaaaagccaaaaccaaacttttctattcagaagtatgttttcctctcaggcttccctgtgtgtgtgtttccctccattcaagtattcgtatttaaggctgggcgtgatggctcacgcctgtcatcccagcacttgggaggctaaggcaggcagatcacttgaggtcaggagttcaagagcaacctggcctacatagcaaaaccctgtctctactaaaaatacaaaaattaaccaggcttggtggtgtacacctgtagtcccagctactcgggaggctgaggcaggagaatctcttgaacccgggaggcagaggttgcagtgagccgagattgcgccactgcactccagcctgggcgacagatcgagaatctgtctcaaaaaaagagtccatattcaagaggtaatgacttaaaatgactcatagcaagaggtgggaagcagaaaacctccctgccctaagaaacagactgagcaaatggccgcggtcccaaagcttaagtggctactgcacttgaactcaaagtccaaccctgagacaatcaccattaatgccaactacatggtccatttctggagaatacctcactcacagcctaattcaaccacatattcaagaaatcttgattaaatgctgacattgctaaatcctcttaatatttctaataatttattatagatccttttagatattctgtacttcaggatttccaagaaaaacaaaaacaaaaacaaaaatctttgtttaaactcctgtaggtcagtttctcccccaaatagaacactgaatttccattaccattgcaagcagatccagagtgaacaggattgttttagcagggaaatgttcaactgcatataaacagggctcgtttgagtttagggaaaaaaaagcatgagggaagcaggattattttcttcagtcaatactgtcaaagggactttgcctttttttgagagagagttttgttctgttgcccagcctacagtatacagtggcacaatcatggctcactgcagtctggacctcccaggctcaagcaaccctcccacctcagcccctgccccgccacccccaagtagctgggactacaggcacatgccaccacacctggctaatttttttttgaagtttaatagagaaaaggtctcataaagttgcctaagctggtctcaaactcgggcttacgtgatcctccacctcggcctcccaaagtgctggaattacaggcgtgagccactgtgcctggctaatttttttgaactttagtagagaaaggtcttgctacgttgcccagtctggtctaaaactcctgggctcaagtgatcctctcaccttggcctcccaaatgctgggattataggcgtgactcagtgagcctggctgccttgtccatgtttttgggaggaaggaaacaaggcggagagaggggacagtgagtaggaggaattgtctagaggtttgctgctgctgaaaaagcagggtaggtgaacagaacttcttccccatctgaagcattaaatagaatagcattaaatagtgtcattaatgaaacgttgggctgtatatgtgctgtcaaattggctgtttccatggacttgtttagtttttgttttggattggcatatacgctggtctgtcaggcattcttaggtgtagttctgcagggaggcaaatgggtgaaccaagtactttttgggggtcacaaagctacctgtgacttgaatttcccatgtttacctgaccagatgccttctgcaatgacacttgtagataagaggtgaaggtattcggatgaccttcttcctttgggcttgaagttgtttctgccagagattgcccagcatgcgtgacagacacgggcatggtgagctgtgttatcacagggagaggctggctgctgggttcagatgcggctgatgttacctgtgatgtgatacttgatagtactgaaggaaactggctgatgggatgacacagggtcttggactaaaagataaaaatatgtaaaggaaaagactgaatctgattttaccattttataattaaggcagcatttccccaaatactctgaaactctgtcctatgagatactaataggcatttctgttaaaaaaaattctgtgctcaaacagaattttgaaatttcaagaaatctgcatattacttgagattcatgatttatattagtgtatttattgtcaatcgttcaataaattcttaaacatttataagttgctaagaatgttctagagaactgaatatggcaatgagcaaaaggagccaagttcctgcgcttgtcgagcccctgtgttagtggtagaggcagagaaacaaattatgtcacatattaaatacgtgctatgaagaaaacaataatgctaagcagagagaaagtggatgtcatggaggatgttcagtggtaaggagaggattttttttttttttttttttttttttttgagacagagtctcactctgtctcccaggctggagtgcagtggcacgatctcggctcactgcagcctccgcctcctgggttcaagtgattctcctgcctcagcctcctcagtagctgggattacaggcgtgcaccaccatgcccggctaatttttgtatttttagtagagatggggtttcaccatgttggccaggatggtctcgatctcctgaccttgtgatccacccaccttggcctcccaaagtgctaggattacaggcgtgagccactgcacccggctgaggagaggatttcttgagactggttgtcactctgtcacccgggctggagtacagtggcacaatcatggctccttgcagccttgacctcctgggttcaggtaatcctcctgcctcagcctcccaagcagctgggactacaggcacacaccaccatgcctggctacttttgagatggagtcttgctctgttacccaggctggagtgcagtggcgccacctcagctcactgcagcctcctcttcccggttcaagcaattctcctggctcagcctcctgagtggctgggactacaggaccacatcaccacacccggctaatttttgtatttttagtagagacagggtttcaccaccatgttgcccaggctggtctcaaactcctgacctcaagtgatccgccacctcggcctcccaaagtgctgggattacaggtgtgagccactgcacccggccttttttcacttttttagacaggatttcactacgttgcccaggctggtcttgaactcctagcttaagcgatcctcctgcctcggagtcccagagtgctgagattacaggcatgaggcactgtgtctgatggagggacatttttgctgagttgaatacagggagagagagagctctgcccataggttagtgacggtatgtgaggagtgcaaaggcccccaagcccacagccagctagctctgaggaagaccaaggaagctagaggagtgatggtggcaggagggggattcaataagatcccagggccaggggagtgtcatatatcaggcagttgaagggaatgcagatgttatttttaatgaggcaggaagacaaagggctttgcagaacagtggcatgatttcacttgttttcacggatccttctgtgttttaaatgatcaaccattctgttgagaagggtcagaaaagggggcaacagtagaagcagatcagtaggaggcaaatgtaaaagttcatttgtaaattttttttttgttttgaaatcgtgtctccttctgtcacccaggctggagttcagcggtgcgatcttggctcaccgcaacctccacctcccaggttcaaggaattcttctgcctcaccctccccagtagctgggattacgggcacctgccatcacacccggctaattttcatatttttagtagagatggggtttcgccatgttggcctggctggcctcgaaatcctggcctcaagtgatccacccaccttggcctcccaaagtatggggactgcaggcataagccaccgcaccaagccagcaaacgtgaaagttcagatgggagatggtgacttggaccatgtggtgatcgtggtgaccatggtgagaaggggttagatttgggacctgtgaaagactgcaaagtcctatagtcaaaagcctttgttgtcttctcttccagcaacatattataggggtggcaaaactccacctccattctcttagggctccagctgggcctgagaattaaactaacataagataaacgggagaaaagcacacacatttattgagtccaagttttatgtggcacaggagccctcataaaaaaaatgaagacctgaagcagcagttagagtccatctctcctatgctgaattggacaaatagttgtgaagaagtgaaattatgtggggaggcttaaaagataagcgttatcttaacaagtcctgtgcagaattctccaggtcttgacttctcctggaggacaacaatgttgcatatttcacaagagaattttaccttgtttttaagaaacggtaccaaggtcagagtgctgtttttgcacctgccatttttcaaatgcctttaactgaaatcatcaatatagcagagtggcatatttttatctctttcaatttcaagggctagtggttgttgctctgcagaaaacagcgtgggaaatactgagggtttttttgttttgttttgtttttgagatgcagtctccctctgtcgcccaagctggagtgcaatggcacaatcttggcccactgcaaactccgcctcctgggttcaagtgattctcctgcctcagcctcccaagtagctgggattacaggcgctccaccaagcctggctaatttttatacttttagtagagacgaggtttcaccatgttggccaggctggtctcgaactcccgacctcaggtgatccgcccgcctcggcctcccaaagggctgggattacgggcgtgagccaccgtgcccagcctctgttcttttatactgttagaaacacttatttttgcagcgagcattgagtcaaacaaatgcatatctgtgtttaggcatcaactaaagggtttctacataggacacaagggcaagaatgctgagagatttcttgaaggtgaaattttatagattatgtggacagtttctacctttatttcctttccctttctgttagatgtttacgttttattgcattgtatttttgtaagatgccacaagtcctttctggaatgaagcagggaataaatacccaaccaacaaacacttgataattacatcagcatgaaagccagaaagagaggctttaaaaattccaagtttggaggtggtggctcacacgtgtaatcccagcagtttgggaggctgaggcaggtgaattgcttgaggtcaggagtttgagaccagcctggccaacatagcaaaactccatctctactaaaaatacaaaaattagctgggtgtggtggcgcaggcctgtaatcccagctacttgggaggctgaggcaggagaatcacttgaacccgggaggtagaggttgcagtgagccaagatggatggcaccattgcactccagcctgggtgacaaagtgagaccctgtctctcccaccaaaaaaaaaaaaaaaaaaaatccttgaatgaagtacctattaaatccaatttttttcttgcacgtaagtactttattttccttattagaaaactatattcagaacactctacaagatagagctctaaccagatctactaggtatgacaaagagatcaacatttcacaatgtatgttgtcaagggaagcacttacaagatgagcaggaagaggatagtgacatgtggttggaagatgaccaggtcctatagaaaaaagaaagcagactaagttcaagtaaaagcctaagacagaaatattcgttttacttgaggacttcttattcatggctaaaaataatgcaaattgttttacatagaaaaccaaggccggacatggtagctcatgtctgtaatcccagcactttgggaggctgaggcaggcagatcacttgaggtcaggagtttgagaccagcctggccagtgtggtgaaacccctatctctactaaaaacataataattagccgggcgtggtggcggatgcatataatcccagctactcgggaggctgaggcaggacaattgtttgaacctgggaggcagaggttgcagtgagccgagattgtgccactgcactctagcctgggcaacagagctagattccacccccaccccctgccaaaaaaaaataaaggtaaggaaggaaaagacaaaagggaacctatgatgatcactcgaggacctgggaatggaatccagaggactccaaggaaagcacagccctgaaaattatcaacaacaaaatccagaaaaaaagttcagaaagctgttaatacatccttaataagaacatccttaatagaacgaaaaaggttatttccccaaataaaaggtctcacctatttattactgcatcagcttatgagtgaagaacacagaaacaaagagaaaaaccattttcccagtaaaaaatgcctgaacatatgggacattttcagcttgaaaaggtaagatgacagtgattgatacagggacgaccttgattgatacagcataagtatatgtgccatcttaacgtgcagttccttacagacccagcatgcctgttctccagtgtctcctcttggagttgtacctgattttatcaccggtttcatccgaatccactggggaataaaatgattttgcttttatttcttggccaggaatcacatgatcctgaaagtcttgtgagaagacatggcaagaaaccgagtcaaccacacccaccatgatgatggagaaaggtagaggtaaccaaacaaaatcctaaggataaccacttgaagctaacatgcaccagaatgaggtacattaaaagaaaaataaacgatatcaaaggatttcaagatgacaaaaaaaatactgtagaaaaattaaaatccacatgggagggaatactgagcagatgtggaaaaattagtccctgatatggaagataaatgtaaggtgctctcctaacaacaaaaagggtgataaatacgaaaccattctttttcatttaaagagtacaggaaagacacagagggtaggaagcagcaatatggcacgtagatatctggtatttcctaaggacaaaaccacaacaaatgaaatagaagtgatacatacgtaggatattcttgattcaaaaaagatgtgtatatgtagcatcatgttctaagcacaattagtgaaaagtaacctagatacacactgagaaaatttctgaattacaaaaaacttttacaagcaatctgatagagattttaaaaggatgcctggagtgcggtatggctctaacagcctctaactcctggatttaaactatcctccttcctcagcctcctgagtagctgagactataggcatggaccaccacatctaatttttttaatttttatttttaaaagttttttgtagagacagagacccagtatgttgcccaggttggactggaactcctggcctcaagcagtccttccaactcagcctcccacggtgctgggattacaggtgtgagccaccgtattacacccaagccacacctaggattacaggtgtgagcaaatgtctgctgaggggagatccagcccgcaaactttttaaaggaccctacgtacataaatattaggcatattgcttgttaggtaaattgccccacaataaggcagtctacatttttcccaatgaggagattttaaaaagtattcctggggcaagcttgacaatataaacttaaaggatataggtgaaatagtcaaatgtctatttaattcagtaatttagttttactatgacacttaaagccacatgttacgtaaggtaataatggaagcattgctctcactaaactcacattgcgggacacagcttaaacatttcaaatgtgtctttaacatcattgcattaattatcatcagaacaacttttggatttaacagttttccaaaatatgtcatctttacttccacctaatgctatcactaaacattttcctacaactcacaagtcccaatttacaaaggattgagaaaagctggattttacatttgttctttaaatatatattcatgtctctaaataaaaccttctatattgctaagtgatatttaaagggtttgttgatcaggacatctaacatttgcagctgtgaggtcataccccgaagagtgatcacgagatccactttaaatcgatctgtttcacttctttctttcagttgatctctataaccacccatccaccgatattgattgccgtcatttcaggctaatgcatccttcccaaatagtacttgtttttcaaaattaaataaacaagtgataacaccataatttgaaagactttgcaagaactttaagacgactactttgttgatgaaaaattttgtgggaataaaaccttgtcttttatttgggaatatatgaaaagacggcggccaagggcatatcaagaaaacacatacataaaatgaaggcaaagactgccatattaagatcagacagaatagaatgcaacgaatattgggcacatgttataacacatttcagcattaattcagtcttgtgcattcttttagcagaaattgattccacggatttttaaggttactagaggagtaacgcattacctgggggcattttgtctcttgctattgcaactcctctttttgtcttcttgtgtctctggtacaaatgggaattatttccatttctttcataatgggcatctccgtccaaaaagtcacctatttgaaagccaacacacaagttaatttataggttatagctatggctacaagtctataaaaccatcattacatgcacgtatgtgataatcaggaaaacacaaattaaaaattcctatccagttttttaaggacactaagaattctgcagtagcccttttgctctgctcacattatggtgtcccacatttcaaattaagttcactagttgggtcaacactgagaagttcattaacccatttatgcctagtgttccattattggaacactaggcatgtggagttatttacatcctactgcttaaggtcatcgccagggtctgatttttcaccaaaaaagtttgcaacctccagcataaatggaaaattccatactaagcgtaatattctcctttgagttctgtaactctcattggtagagataaaagagttcagaaggtggatgataacattcttttttttgagacaatttttgctctgttgcccaggctggaatgcaatggcacgatctgggctcactgcaatctgcaccttctgggttcaagtgattctcctgcctcagcctcccgagtagctgggattacaggcacgtgccaccacgcctaattttttatttttagtagaaacgaggtttcaccatgttggccaggctggtcttgaactcctgacctcaggtaatgtgcccgccttggcctcccaaagtgctaggattacaggtgtgagccaccacgcccgtctggcaataacattcttgaacatgcctccttgcatacacgagcaagagtttctcacacacacaattggacatggctagagaaaatcatataaccatgatgactatggctcagcttaaattcgctatcgtgaagctcgagcagcctgccttcatactgcctggcagtcatactgtttccactctcccaggtgactcccacttccctctctctactcaacctccaacacctgggagcctccctcagtctcattcttaggtcaggtgataaccttgctttctaactcaaggggaatatcaaagcaatttagagtccttccatgactctgaccatcaaatctagctgtctaccagcacctgtacctgtagcgagacaatgccttctctcatgctgctacaaatcttcctactcctacccaaagtgaatccctctagttgtttggtagctcagattaagtacatcattcctgcatgctatttcttctgccttaaaaaaaacccagcaacttatattggcctcatgaactattgccccagctgtttcctgctcttgagcaaaattaccttaaaaattgtccaaacttatcagctccaattcttctcctcccctctttttccctacatttagggattgctttttacaatgttaacaggctgggtgtggtggctcatgcctgtaatccccgcacttagggaggccgaggagactgtatcacctgaggtcaggagttcgagaccagcctggccaggatggtgaaaccgccgtctctactaaaaatacaaaaattagccgagtgcctataatcccagctacttgggaggctgaggcaggagaatcacttgaacccaggaggtggaggttgcagtgagccaagatcacgccattacactccagcctgggcaacaagagtaaaactccatctcaagaaaaaaaaacagttgacttaaatttgttttataattgctttagtctgttttgcactgctataacagactaccacaaacagggtaatttataaagaacagaaatctaatgctcacagttctggaggctggacgtccaagaagaaggcactggcacttggagttgggggaaggctgcaacctcgtaaggtgaaaaggcaagagaagccctccctctgccaagtccttttataagggcccctaatcccattcacaagggaggagccctgtaggccaacccacctcttaaagccccacgtcttaatgcgatcacattggcaacacctgttttggaaggggcacattcaaaccatagcaataattatggaaaacatttaaagagttccaatgccaaactataaaaccaggtacatttcgaaaggtctcatttccatcttcatcctttctgccctattttctctctccctcataggtaaccattttcattagtttttgtttctccttctgttatatttatacgtacgtgtatgtatacaggcaaatatatatgttctgtacctttattttccactaaaaaaatacatcatagagataaccccactgcagtacatggagattgttgttatttgctttttacaaccagttccctcttgatgggcatgtggattattcctacttttttctatcacagagagctacaatgaatagccttacgtgtgcatctttttgtacttttgctggtttgactttgggatagattcctagcagtggacactgggtcaagggtagatgtatatgtaattttgctagatattgctgaattcccctttatttataaatatatacagattatatcttactgcattctcactagcaacttatgagagtacctattttcttatggccttgccaacggaaagtgttgttaagtttgtggatttatgccaatctgataggtgggaaagggtatctcagtttatttttaatttgcattacgctattttttttggcaaaaatactgtgtaagtgatgtgtatacttacatcagtgcatttttcttttttttaaaaaatgtaacttattattttgagataattgtatattcacatgccgatgtaagagaaaatgcagagagatgcctttatccagtttccaagggtaacatcttgcaagggtaacaacaggatatggacgctgatacagtcatgtcaaaattttttttcaattgctataagaatccctcacattgacccacctcccccgcctttttttttttttttttttttttttctgagacggagtcttgctctgtcaccaggctagagtgcagtggcgcaatcttggctgactgcaacctccgcctcccggttcaagcgattctcctgcctcagcctcctgagtacctgggactacaggtgcacaccaccacgcctggctaatttttgtatttttagtagagactggggtttcaccatgttggccaggatggtctcaatctctttacctcgtgatccacccgccttggcctcccaaagtgctgggattacaggcatgagccactgtgcctggcccacattgtccttttatagcgacgcctacttccttcctgcccccatgcccttcttagaccccgacaaccactaatctgttctccatttctatcatgttatcatttcaagaatgctcaataaatggcaccatagagtacgtaacattttgagattggctttgttcacttggcacaattctctggagattgctgtgtgtatcaatagtttgtttctttttattactgaattggactccatggaatccaattcaacaaccagagggattcactttgggtaggagtatgaaggtttgtagcagcatgagagaaggcattatctctctacaggtacaggtgctggtaggtgggtagatttggtggtccgagccttggacggactccaaattgctttgattttttttttttttttttttctccttgagttagaaagcgaggttatcacctgacctaagaatgagactgagggaggctcccagttgttggaggttaagtagagagaggaaagtgggaaagagtcacccgggagagtggaaacagtatgactgctatggctagaccacagtggtttaatcattcacctgttgacagacatctgaattgtttccagttttgttctgttatgaataaagctgctataagcatccatatacatagttttacgtgagcacaggttttctcattctgcgataaatgcccagcaattgctcagttgtatggtagttgttttttttttaagaaatcaccaaggccgggcacggtggctcattcctgtaatcctagcactttgagaggccgaggtgggaggattgcttgagtccaggagttcgagaccagcctggacaacataacaagacccccccccccacaaccactccccactccaccgtctccacataaaaaaataaataggctgggcgcagtggctcatgcctgtaatcccaacactttgggaggccaaggcaggcggatcatctgaggttgggagttcgagactggcctgaccaacatggagaaaccccatctctactaaaaatacaaaattagccgggcatggtggcacatgcctgtaatcccagctactagggaggctgaggcaggagaatcactggaacccgggaggcggagcttgtggtgagccgagattgtgccattgcactccagcctgggcaacaagagcaaaactcagtcttggaaaaataaataaataaataaataaataaataaataaatacaacaactacacacacacaaatgcatacgtacatacatacatagcttaatcctgatctacttctgcagaggcgaacctcggataacagccctctcaccgttcgacttctcatcttcctctgccttattctcttctcctccttctctttcccatccttccctctgaagcccaaatgctgactgaattatgagtgtgcatgtggaaaatggtgtcaccaatacaatttctcccacactctgcccaagtcaaaacacgaggaggacatcaaggcacaactcttccaactcccagtggggatggatccaaggaagtcactccagataattttctcatgctaatcagcatcatgaaaatcaaaagccctgtatcatcccatggtctaacactcacagactatttaaccaatattctcacatgcactccttatttagaatcagtttctaaaatttgggtctttggcagcatgtagctttatcacttaccagtctggcaaatgaaatagtatttcagtaagcacttgtcccctttggatgagatccgaatgaagtttctggacaggtaggtgcagctgaggggctttgggggcccgttggctgcaacgtctgctgaggggagatcagacgcagatgagcctcatactcgaaagccaggcttttaggtttattttttattattgtttttgagacagtcccactcagtcacccaagctggagtgcagtggtgtgatcttcactcactgcaatctctgcctcctgggttccagtaattctcctgcctcagcctcccaagtagctgggattacaggcacccgccaccacgcccagctaatttttgtatttttagtagagatggggtttcaccatgttggccaggctggtctcgaactcctgatctcaggtgatccatccacctccaccttccaaagtgctaggattacaggcgtgagccaccacacccaccctgccaggcattttttaaaagtaaatatgaaagccaaatttgactgacttccaatagataaaaatgtagaatttcctcccatacattatagtttattttttcatatgtgttccttaccacaaggcttagtattactttatctacacgttaatgaagatgatgagaatgatataataatggcttggatttgtctctaaaacttcaagattatggtgcataactttgaaaacactttgtaagggccgggcgcggtggctcacgcctgtaatcccagcacttttggaggccgaggcgggcggatcacgaggtcaggagatcaagaccatcctggctaacacagtgaaaccccgtctctactaaaaatacaaaaaattagtcgggcgtggtggcggccacctgtagtcccagctactcgggaggttgaggcaggagaatggcgtgaacccgggaggcggagcttgcagtgagccaagatggcaccactgcactccagcctgggcgacagagcgagactccatctcaaaaaaaaaaaaaaagaaaaagaaaacactttgtaagaaagacaataggtagatactcttcctcttagttttgtgttaggaaacttagagatcagaataatgaagagatgtttattaggaaaaaaatgaccatcaaagtttctgtctttggaacgtagcataattcttttagtgaaaggtcaggtaagttaactttagatgggttccaggaaaaattgcatcatttttgctaacagacaaatcaaaggctgtcgcacaaaatggaaatatttcagaggaaagatggtaatgaagtaaagtgactggtttttctgtctacaaaagcagaaagattaagattttcttttttttttctgtcccagaataaaatataaggaagtttccttcataaacactgaaccccagggtcttacctgggtatttgttgtcttgatgctttttcaatggcattacattttgcccaatccaccacttctttccttcttccagatagtcccggatgagatcttgaacttccttgttccaaatatgagctaggaatcctctctgcacatgacagtaatgctgtgcttcctcaaagctgcattgaaatctgttaagctggtaacaattattttgcccatgtggtgctgggctgtttagctcacttcctagaataatacttgttctgatgtataaccaaagccagcttcctcctttgaagaacat

SEQ ID NO: 2210 - DNA, 17187 bp, Homo sapiens
cgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggtgaggaaggaggctgcgtggggacggtgggcggccgccttgagaagagggacacctgcgtgggaatgggtcgtcacggtgacgcagaggggtctcccagagaggcgggactggtcggccgcctagggccaccgaaaggctagcgaagggtttccccagcctccttaccttgagtctgttaggttttctggagattggcttcgttggagcagagggtaccgctacctcgggaaaatgacttagtgcctaggtgtcgtggccacttgcgcaccgcgtcgtttcggggtcgatagccttggcggatgcgaggggggccaggcctgtgcccacggatggtaaggggagacgggggtacaagagcaccccgcggaggccagagacgcccgagatcgcgtgtgtggcagcgtctcacctgctaagtgcccaagaaatgccagtgccgcccggaggccgaggtgagggtggactggccggacttcgctggcatcagagcggcacttgtttatggggcaggagggagaagtccaatcccaagccggttaaggggagctttcgtcttttgtgtatatatatattacatcctcttggactttgattagaccaagaatcaaaatctgcccacctcagtgcaagtttaagctgaatggtgtggaatgagacggaccttaacagagaggtcacaggtttctctgatcgagcatttatgctggctgaagacaagacctgtattatagtctttctttgactattccttagacgttaccttgaacaagtcaggtaactattccggccctcagctctgaaagctctgagatctcttctgatgttaatattctgtgattctcggtgattctccaagaaaaatctagggcttcccctaataaacatcaccttggaggttctctcagggaaactctcaggcagatgggctgcctgttcgggtaactctctggaaagcgtcaatcatcagcatactcccagtagtcacgacttggactcaaacgaggctggttacgcatcgctgtggaaggaaggaagaggagacatttttctaattgatctgactccgtcacgtccttgagaacactgtgattctgtgaaaacttcaggggatgatggatacaagaagactaaatcgtgcaaggataaacgaatctcttctcttactgtttctatgtggattgggtggcagcagaacgcatagaacccccgctctttgtatagtggtcgtgagaggatgtcacataggtctgatcctgaatccagaattttttgtgtcgcagccttagttctgccactggttcttttctttctttttttttttttttttgttgtgttgttttgttttgttttgttttgtttgagacagagtctcgttctgtcgcccaggctggagtgcagtggcacgatcttggctcaccgcaacctccacctcccgggttcacgcaattctcctgcctcagcctcctgagtagctgggattacaggcacacaccaccacacctggctaattttttgtgtatttttagtagagacagggtttcattatgttggccagactgttgttttttgttttattttgagacggagtctcactctgtcacccaggctggagtgcaatggcacagcctcagctcactgcaacctccacctcccggattcaagcaattctcctgccttagcttcccaagtagctcggattacagatgcccaccaccacacctggctaagttttagtattttaatagagatggggtttcaccttttggccaggctggtctcgaactcgtaacttcaggtgatccacccacctcggcctcccacagtgcagggattacaggcgtgtggctcacctggccatgccactggttcttaattcacagattgaacaatcaattacttagttacctaagtgggccacttttagagtaaatggggcagtgttattatggtgtaatgatacaccaggactagaatgagtcgccaaactgctaacgtttgggtttcagaagccagaagtgacctctcttttacttagagtgcagccttctattaatgaagtgattcttaagcctccaacattagtatgtcttagagtcatctggagagattgttaaaaaggaaattctccgctgggcacagtggctcatgcctgtaatcccagcactttgggaggccgaagtgggcagatcacctgaggtcgggagttcaaggccagcctgaccaacatggggaaaccctgtctctactaaaaatacagaattagtcaggcatggtgatgcatgcctgtaatcccagctactcaggaggctgaggcaggagaattgcttgatcacttgaacccaggaggcagaggttgcggtgagccgagatggcaccattgcactccagcctgggcaacaagagtgaaactctgtctcaaaaaaaaaggaaattctcacccaggtgatgccgatgcagttggtcaaagaccacacttacaggaaatactgctttaacttgcccggctctcctgagagagacatttcttctgctgaatattgacatcgctaacattgatgcatagattgagatgccatgcgcctaaaaaacatttgatcatgatcaccactatttgatattgatctgcctacagtgttgaaaaaatggatcttacctaatgccaagttgagatcaatgcctgtctatcctacaggatctatcctatgggattcattggggtactgttcccaaacattcactcatatggctctttccctcttggcaggatctcccagccatccagccccggctagtggcggtcagcaaaaccaaacctgcagacatggtgatcgaggcctatggacatgggcagcgcacttttggcgagaactacgtaagagccctttcctgaagccctttggaagcatcatgattgccaggcttctgacttgttctgttttgaccttttaggttcaggaactgctagaaaaagcatcaaatcccaaagtaagtagatagctgaattctttaatttgtatctaaatcttggctctttagttgaaaattagacccatcctggtggttgagttgtacagcagttttagggtggttgactttagattgggccagggatagaaatgtcagcttcctccttgagccccaagtaattctcagctagatttttctctttgttcagactgtcgttttctcattggtggctgtttggaaatggtggtttcaggagcttgctgtaatcttggatcttttcaagatttgaaagcttaaatcagttcatcctagatgggcaatatctgaaagatggagggaattgatgggaacaaggaaggaaaacagaacagaagccttagatttttctctatccttttacctcattaggaggccgggtgaagattgtgatagtttattacatttaaggaacagagagtggatgtgaaaggtgacagggagtgcacgaggcgtttgagccagcaaggcctctataaaatctgaattacacatggttacctttttcccctcagattctgtctttgtgtcctgagatcaaatggcacttcattggccacctacagaaacaaaatgtcaacaaattgatgggtaagataaaattaaatatgaaaacaaaattgttctgtcattgtattgcttctactaccctttgtggaagagagagcaacttttagaatagccccaattcaccatttgtttttggaatttctttaggaaagtctgagttcttaataaaaagagaaaacatcatgccaagaacagaatgaattcaccattttctgggttatatatacttggaaacctacccaacctcatgtttattattatttggtggtctttcagaaaaattataaagaattgtagcccataaatttttttaactagcaaaagagacatttctgttctttttcctttaaataaaaggctacagtaaataaaatacaatacagtaaagtaagtatagtaaagtaaaattaagaattatagtaaagtaggccaggcgcggtggctgacacctataatcccagcaccatgggaggccgaggcaggcggatcacctgaggtcaggagttcaagaccagcctggccaacatggtgaaaccccaactctattaaaaatgcaaaaaaatagctgagcgtggtggtgcatgcctgtcaagtcccagctacacaggaggctgacgcaggagaatcgcatgaacccgggaggcagaggttgcagtgatccaagatcacgccactgcactccagactaggtaacagagcaagacttcatcccaaaaaaaaaaaaaaaaaaaaaaacaagaatcatagtaaaataaaattaagaaagacatggagatcttgagtaactgaacttatttcccttaaggtataaaaatttaaataacctgtatatattttgtaacagctttattagggaggtaagtgacttacaatacattgcacatatttaaagtatagaattcgacgagttttgatgtatgtttgcacctgtgaaaccatcacaacaaacagtgagcatatctatcacccctaaaagtttcctcctgtcccttggtaatccctctcttacctgtcccacttctcttcctcaagaaccacttacctgcttttgtcactgttaatgtacgtgagtttacattttttagagttttatccaaagggaatcatgaagtatgtactcttttttgtctgacttctttcattcagtgtagtgattcatcatgttcatacctgtatcaaaggttcaattctttttatcattcagtagtattccattgtataagtatattacaatttgtttatccattcacctgttgatgaatgttgggttgcttctgatttttgactgttgcaaataagttgctatgaatatttgtgtacgagcctttgtatggatatatttccctttttcttggaataaatatataggaatagaatggctgaatcacaagttaagtgttatgtttaactttttataactgcaataaaacaaacataaaatttactgtcttgatcttttatttacttttttttttttttttttttttttgagatggagtctcgctctgtcgcccaagctggagtgcagtggcgtgatcccggctcactgcaacctccaccgcccgagttcaagcgattctcctgcctcagccttccgagtagctaggattacaggcacatgccaccacacctggctaattttttacgtttttagtagagacaaggtttcatcatattggccaggctggtctcgaactcctgaccttgtgatccacccgcctcagcctccgaaagtgctaggattgcaggcatgagccaccatgcccggcctattgattttcaaatgttaaaccaaccctgcactcctaggataaatcctacttgaaggctgggtctctattaatcttattatatgtcatataaacaaaataactgtgttatgggatttataactatgtaaaagcaaaatgcatgacaacaataacagaaggggataaacagaagtacactattgtaaagttcttaaactgtgtgaagtagtgtaacacaccttgaaggtggactgttgtaagttaaaccccaaagcaaccaataaaataacacaataaagagttatagcttataagtcaacaaaggagatatattggactcaaaaaatgtgaaatggtatctccttacagttttgattttctttttttttttttttttttttttttgagacggattctcactctgttgcccgggctggagtgcagtggtgcgatctcagctttctgcaacctccgcttcccaggttcaagcaattcttctgcctcagcctcccgagtagctgggactacaggcgcccaccaccacgcccagctaatgtttttgtatttttagtagagatgcggtttcaccatcttggctaggctggtctcaaactccagacctcatgatccgcctgccttggcctcccaaagtgctgggattacaggcgtgagccaccacgcccggcggttttgattttcattaataacgaatgatgttgagcatctcttcatgggcttattggccatttttatgtcttctttggaaaaatgtctagtcagtcctctgcatgttttttaaattgagttgtcttttcattattgagttgtaaattccagctagattaaataatctaacttgaaaataaaagctataaaagtattagaataaaatgcaggaaaatatttttattttcttgggcttttctaagcaagacataaaatctggaaaccataaaaaaaacaactaggccaggcacagtggctcacacctgtaaatctagcactttgggaggccaaggcaggtggatcacttgagcccaagagtttaagaccagcctgggtaacatggcaaaaccctgtctccactaaaaatacaaaaaattagctgggcgtagtggtgtgtgtctgtggtcccagctacctgggaggctgaggtaggacgatcacctgagtccaaaaggttaagcctgcagtgagctgtgattgtgccactgcactccagcctggatgacagaggagaccctatctaataataataataatattaataataataaattttaaaagaacaactagcagatttgatcacacaaaaattaaagctttctgcatgtcaaagcaaaagggaggcacagagtggaagaaaaataatatttttgaagagggaagagattcatatccagaatacataaagagctacaaatctttttgtttatagggaaaaaaaataggcaaaaactggggcaatttataaggggtaaaaatacaaaaggccagtaatcaaatgaaaaatattcatcctcagagaaatacaaaatcactaatcagatttgtaaaaaatcaaaaagactgctaagatccagtgttttgagggagtgagtaaatgagtactccttcgtcttaccaggagattctaaaaccgtagagtcttggaaaaacataaagattccaccaaaaaactattataactgaaaaacaacttcagtaacattgcaggatacaaaataaatatacaaaaatcagtagcatttctatatgccaacagtgaatgatctggaaaagaaatcaggaaagtaatcccatttacaatagctacaaatgaaatacctaagaataaacttcaccaaagaagtgaaagatttctgcaatgaaaactgtaaaacactgatgcaagaatttgaagaggacatgaaaaaatggaaagatattccatgctcatgaattggaaaaatcagtattgtcaaaatgtccttattgcccaaagcaatctacagatccagtgcagtccctatcagaatactagtgacattcttcacagaaatagaaaaacacagtcctgaaatttatatggaaccacaaaagacccataatagccaaagccatcctgagcaaaaaacaaagctggaggaatcacattacctgacttcaaattatactgtagagctatagtaaccaaaactagcataaaaacagacacatagaccaatggaacagaatagagaactcagaaataaatttgtacatctacagagaatttatttttaacagaggtgccaagaacatacattgggaaaaggacaatctcttcaataagtgctgctgggaaaactagatatccatatgcagaagaataaaactagactcctatctctcaccatgtacaaaaatcaaatcaaaatagattaaagacttaaatctaaatccaagacctgaaactactaaaagaaaacattggggaaactctccaagacattagtctggacaaattttgtttgtttgtttgtttgttttgagacagggtctcactctgcacccagactggaatgcagtggcatgatctcggctcactgcaacctccatctcctgggttcaagcgattctcctgcctcagcctcccaagtagctgggattacaggcacgccccaccatgctggctaatttttgtatttttggtaaagacggggtttcaccatgttggccaggctggtctccaattcctgacctcaggtgatccgcccacctcagcctcccaaggtgctgggatcgcaggtgtgagccactgcacctagccatgttagaaatatgtaaaggtgatgggaggagggagcggggaaggagccagcaggcatagaaggggcaggaaaacctaacagaactgttgttttagtgccattttcccttctggatgatccgttatactcattcaacctcacagctcaattcatttccataaaggcttcttgaggccagatgcagtgactcacaccagtaatcccaacactttgggaggccaaggtgggaggatcacttgaagccaaatacatatatgtatatttctttcttttttagtctttctagtcttgctctgtcacccaggctggagtgcagtggcgtgatcccggctcactgcaacctctgcctcccagattgaaggaattctcctacctcagcctcccgagtagctgggattacaggcatgtgccaccaggcctggctaattttttttgtatttttaatagagacagggtttcaccatgttggccaaatggatctcaaactcctggcctcaagtgattcgaccacctcggcctccccaagtgctgggattacaggcgtgagccacaatgcctagccatctctggctaatttttttattttttggtagagacagggtttcactgtgttggacaggctggtcttgaactcctggcctcaagtgatctgccctcctcagcctcccaaagtgtggggattacaggtgtgagccactgcacctgaccttgacaaagattgcttgagtaaatactccaaaagcacaggcaaccaaagcaaaaatggacaaatgggatcacatcaagttaaaaagctcttgcaggctgggcacagtggctcacgcctgtaatcccagcactttgggaggccaaggccagcagatcacgaggtaaggagttcaagaacagcctggccaacatggcaaaaccccatctctaccaacaatacaaaaattagtgaggtgtagtggtgggtgcctgtaatctcagctacttgggaggctgaggcagaagaatagcttgaacccaggaggcagaggttgcagtgagccaagattgtgccactgcactctagcctgggcgacagagcgagactctgtctccaaaagaaaacaagctcttgcagagcaaaggaaacaacaaagtgaagagacaactcagaatgggagaaaatatttgcaaactgcccatctgaaatacttgtacatagcaccaagttctatatccaagctttgtttttgtaataaaaaataagaaacaatctaatatccattaacgaggaatagttatgtaaactgtgataatctgtcctgtggattgctgcagttttttagtagagatggggtttcaccatgttggccaggctggtgtcaaactcctgacctcaggtgatccacccacctggtattacacgtgtgagccaccacacctggccagtgttagggtcatggtgatgtccttgttggataagaataccctcatcccagaaagttgaagaattgtggtgatatgctagggaagcatcttggcttccactggtcatcctttcttcattgtcatcctgacctgtttctctcagtttgaactgagacatagatcaagccttttactaggaatctgtccgttaccagcttcttgaagcttatggatgtatatgctgcctgatcatgtatgtcagcttttcccttatttacctttgctgattagccagggatggtctgacatttgaatttgtatctagtaaaactgtcacatttgtcttctcagaggaactgagatttaactgtgtttttcttttcctggcatattttttcctctaacaagtcagagatttgttgcatgttacttgctgcaatagagcaaataaggaatactactttgcctctgtctcattacagctgtccccaatctcttcatgctggaaacagtggattctgtgaagttggcagacaaagtgaacagttcctggcagagaaaaggttctcctgaaaggttaaaggttatggtccagattaacaccagcggagaagagagtaagtaaccagacctgaattgtagatttttcttcctttaggatggttgaagcttagggagaatgggtgggcccaagtgtctgatggataaggttatagaaacaaatcacaggatcacaggcctctaagttggctgttttatgtgtgatctaggtagcataatggcatgcaaagcagtctatgtatcattctttactacatcatggttcattatatcttaattttaggggaagaagaatggatggggagttcaagaaggggattgtgacttcgttttgtatttttgttttttttttgagatggagtcttgctatgtcgcccaggctggagtgcaatggtgcgatctcggctcactgcaacctccgcctcccgggttgaagcaattctcccacctcagcctcccaagtagctgggactacaggcgtgcaccaccacgcctggctaatttttgtatttgtaatagcgatggggtttcaccatattggccagactgctctcgagctcatgacctctcaagtgatccacccatctcggcctcccaaagtgctgggattacaggcgtgagccaccacactcagccttttttttttttttttttgagacagagcctcactctgtcgccaggctggagtgcagtggcacgatctcagctcactgcaacctccgcctcctgggttgaagcgattctcctgcctcagcctcccgagtagctgggattacaggcacgcgctaccacgcccagctaatatttgtatttttagtagagacggagtttcgccatattggtcaggctggtcttgaactcttgacctcaggtgatccacccacctcagcctcccaaagtgctgagattaaagacatgagccactgcacccggcctgggattgtgtctttcatctggaaacccccaaaggtcaccatcactcctacaaggagtattttaaatttttaagacctaagattatataaatactcttagatcttaaaaaaattacttgatgttgcattgggagagaatggaagataattactgtgagtgggccaggtgcggtggcttacacctgtaatcccagcacttgggaaggctgaggcaggtggatcacctgaggtcagaaattcgataccagcctagccaacatgatgaaacttcatctctaccatacatacaaaaattagccaggcatgatggtgtgcacccatagccccagctgctcgggatgctgaggcaggaggatccctcgaacccaggaggtgaatattgcagtgatccgagatcgcgccactgcactccagcctgggcgacagagttagactccatctcaaaaaaaaataaataaataaaaaattatggtgagcaccagtcaatgaatatctttatggggcttggattaacagtgtaacatagtgtgaatagaagcatgggctttgaaatcagacagaccttgggtttcagctacactactttccagtattgtaaccttggataagttacctaatctctctgtacttcagtttccttttttggcaatggtatcatgagaatgcttacttcagagggtgtggttaggactgaatatgataatccaggcaacattgttagcacagaaccctacacatgttgttagctattcgttaagaataaatgtatacagatcaggcatttgattgcaaccatcaaagcaccagtattcaccaaatcttagtatgcaggaacacagtagaggcatctgttttctagataacgtcctagagtcagactacctgggtttaaatcccaattatcaatagaaatctgaaatcaactataggtcaagtctttattgtatcatttcttgataattagctataatatgccctatttaaagactgaagtaaatgttactagtatctccgcctaataaatgggggcaagacaatatcaatagctcttataactgtataacaaataattgcttgctgcagatttctcttccagttgttaattagaaagttcagttaaactttgctaatatatagccaaaaatatttaacatgtactttatactaaattttttgcaactccattaaattaataaaactataaaaattcttgatttagaaaagtaattctcaggttcatctggcattttggcaatgcaaatcttcctggtatcccaaaaaagcaagattttttcttttccatgtctcctagctgttttcagctgaaatcctgagatggaggaaagagaatccaactgatagttcttttcttgagaaatttagaacctgaccagaagcagagcaacatagaaaaccccaagtataaagttactctttaggacttgaggctctttcaagaggttctcttgttgggggtcacctcttctgtcgtaaggaagggaggaaaatggagccttcctctggccatttacccttgcagtatacctgttttctgtttcttttcttgaaggtaaacatggccttccaccttcagagaccatagccatcgtggagcacataaacgccaagtgtcctaacctggagtttgtggggctgatgaccataggaagctttgggcatgatcttagtcaaggaccaaatccagacttccaggtactggggggtcggggagattgctcgtgtgctaaagaagcagggtgctggagtgctattgcagggctggctgcagtggggattgcagagtcatcccagacactgcctgttgagtgttctagccctcttttgaactcttctcagaaggaaaagggaagaacaggtttccaaagccccacaaacctttttcaactcaacttgaacttggctaaaacatagtctttagagaatatgagatttcttcctctccagtgactaatagttttctcgaaagtgggatagtttgcaaaaaaccctttcagtaacgtctggcaattttggcaggccttgaaatcataaggaatacataaccgttgtcagagaagttcagattcagacacttttgggcatcgttagagaaggcaggagtaaaataggtgtcatctctttctgtcagctgttattgtccctccgggaggagctgtgtaaaaagctgaacatccctgctgaccaggttgagctgagcatgggcatgtccgcggatttccagcatgcggtgagtgtcctgccagtgccctgtctgcctcgaggggtgggggtagggggtctgagaggctgacacaagagcagatctttgctgtagaagccttggaaatgccttgggatggcagtaaggtacccagtgtcagctattccagcatctcccattccccatgccctttcttttttgaaaagagccaggtgcggtggcgcacgcctgtaatcccagcactttgggaggccgagccgggcagatcacgaggtcaggagttcgagaccagcctgaccaacatggtgaaaccccgtctctcctaaaaatacaaaaattagctgggcgtggtggcgcacgcctgtaatcccagctactcaggaggctgaggcaggagaatcgcttgaacccaggaggcggagattgcagtgagccgaggtcgcgccactgcactccagcctggctggcaacagagcgagactccatctcaaaaaaaaaaaaaaaaaaaaaaaaacaaaagaaagaaaagaaatgtatagaaattatagcctgacatctgaacttttaaaacaaaatataattccgtaagtgtaatctaaaggaaataagaaattaattataattataatttcataaattataaacataattccataagtgtagtctaaaggaaaataagaaattaagctataatttttggaaaggcatttcattacgtaagtgcgtgggcatggctgtatcacagcaaatcacgatgaagcagcctaaggcttcatgtttgtttgtttttttttggagactgagtctcgctctattgcccaggccggagtgcagtggcgcgatctcagctcactgtaacctccacctcccaggttcaagtgattctcctgcttcagcctcccaagtagctgggattacaggcgcctgccacaatgcccagctaatttttgaatttttagttaagacagggtttcaccgtattggccaggctggtctcgaactcctgacctcaggtaatccacccacctaggcctcccaaagtgatgggattacaggcatgagccactgcacccgtccgaggcttaatcttatgtgtagattcaccaacaatcttatatgtacatcaacagctgtaaatatcaactgatacaggtgtgctagattggcaacgcaaatacatgattttctgaaatagcaaataacttgataaagtttcaaaaatcaaaatataaacttgcattcctggaaaattgtatttcttaaaacagtgcaaaaatacattgcattgataagtaaaatggaatttgatcagataattataaggatatttttttcatctacctgaccgtggcacattggagaggtaggtgggctgtgctgtgtggctgcgtctcacactggacgtctaatgtccttgaccccctccgagctgagtgccagccacactctccaaccactggaaatccagagaaacccaacttgtttcctatatatgccctcagaggcaattttacctctgaggagaacaatcatcctgaagccatcttcagctgtgttattattcatagaaggctctgtttttgtttttttttgttttttttgagatggagtttcgctcttgttgcccaggctggagtgcaatggcgcaacctctgctcaccgcaacctccacctcctgggttcaagcaattctcctgcttcagcctcccgagtagctgggattacaggcatgtgccactatgcccggctaattttgtatttttaatagagacagggtttctccatgttggtcaggctggtctcaaacccctgatctcgtgatctgcccacctcggcctcccaaaatgctgggattacaggcgtgagccaccacgccccgtccatagaaggctcttgagagccagaatgggggcacagcttcagcactggctccattttattattttaaacctggtcctcgataccttctcttttttcccacaggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatga

SEQ ID NO: 2211 - DNA, 738494 bp, Homo sapiens
ctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaatgtgtgagtgtgagtgtgtgtgtgtgtctgtgtttgcgcgcgcgcatctccgggcagtgtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 2212 - DNA, 738627 bp, Homo sapiens
cgtgtgcgtgtgcgtgtgctcagcctcagcgtgaggggcacctgctcgtctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaatgtgtgagtgtgagtgtgtgtgtgtgtctgtgtttgcgcgcgcgcatctccgggcagtgtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 2213 - DNA, 738627 bp, Homo sapiens; identical to SEQ ID NO: 2212
